United States Patent 11,464,842 (COMPOSITIONS AND METHOD FOR OPTIMIZED PEPTIDE VACCINES USING RESIDUE OPTIMIZATION) - sequence listing, part 22

SEQ ID NO: 246228 - protein, 23 aa, Artificial Sequence
  Description of Artificial Sequence: Synthetic peptide
  Seed: VLEHVVRVNARVRIAYPSLREAA (MAGA4_HUMAN)
  Core: VRVNARVRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVXRVXAXVRXAYPSLREAA

SEQ ID NO: 246229 - protein, 23 aa, Artificial Sequence
  Description of Artificial Sequence: Synthetic peptide
  Seed: VLEHVVRVNARVRIAYPSLREAA (MAGA4_HUMAN)
  Core: RVNARVRIA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVXVNXRXRIXYPSLREAA

SEQ ID NO: 246230 - protein, 23 aa, Artificial Sequence
  Description of Artificial Sequence: Synthetic peptide
  Seed: VLEHVVRVNARVRIAYPSLREAA (MAGA4_HUMAN)
  Core: NARVRIAYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVXARXRXAYXSLREAA

SEQ ID NO: 246231 - protein, 23 aa, Artificial Sequence
  Description of Artificial Sequence: Synthetic peptide
  Seed: VLEHVVRVNARVRIAYPSLREAA (MAGA4_HUMAN)
  Core: ARVRIAYPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNXRVXIXYPXLREAA

SEQ ID NO: 246232 - protein, 23 aa, Artificial Sequence
  Description of Artificial Sequence: Synthetic peptide
  Seed: VLEHVVRVNARVRIAYPSLREAA (MAGA4_HUMAN)
  Core: RVRIAYPSL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNAXVRXAXPSXREAA

SEQ ID NO: 246233 - protein, 23 aa, Artificial Sequence
  Description of Artificial Sequence: Synthetic peptide
  Seed: VLEHVVRVNARVRIAYPSLREAA (MAGA4_HUMAN)
  Core: VRIAYPSLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARXRIXYXSLXEAA

SEQ ID NO: 246234 - protein, 23 aa, Artificial Sequence
  Description of Artificial Sequence: Synthetic peptide
  Seed: VLEHVVRVNARVRIAYPSLREAA (MAGA4_HUMAN)
  Core: RIAYPSLRE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVXIAXPXLRXAA

SEQ ID NO: 246235 - protein, 23 aa, Artificial Sequence
  Description of Artificial Sequence: Synthetic peptide
  Seed: VLEHVVRVNARVRIAYPSLREAA (MAGA4_HUMAN)
  Core: IAYPSLREA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVRXAYXSXREXA

SEQ ID NO: 246236 - protein, 24 aa, Artificial Sequence
  Description of Artificial Sequence: Synthetic peptide
  Seed: VLEHVVRVNARVRIAYPSLREAAL (MAGA4_HUMAN)
  Core: VRVNARVRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVXRVXAXVRXAYPSLREAAL

SEQ ID NO: 246237 - protein, 24 aa, Artificial Sequence
  Description of Artificial Sequence: Synthetic peptide
  Seed: VLEHVVRVNARVRIAYPSLREAAL (MAGA4_HUMAN)
  Core: RVNARVRIA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVXVNXRXRIXYPSLREAAL

SEQ ID NO: 246238 - protein, 24 aa, Artificial Sequence
  Description of Artificial Sequence: Synthetic peptide
  Seed: VLEHVVRVNARVRIAYPSLREAAL (MAGA4_HUMAN)
  Core: NARVRIAYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVXARXRXAYXSLREAAL

SEQ ID NO: 246239 - protein, 24 aa, Artificial Sequence
  Description of Artificial Sequence: Synthetic peptide
  Seed: VLEHVVRVNARVRIAYPSLREAAL (MAGA4_HUMAN)
  Core: ARVRIAYPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNXRVXIXYPXLREAAL

SEQ ID NO: 246240 - protein, 24 aa, Artificial Sequence
  Description of Artificial Sequence: Synthetic peptide
  Seed: VLEHVVRVNARVRIAYPSLREAAL (MAGA4_HUMAN)
  Core: RVRIAYPSL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNAXVRXAXPSXREAAL

SEQ ID NO: 246241 - protein, 24 aa, Artificial Sequence
  Description of Artificial Sequence: Synthetic peptide
  Seed: VLEHVVRVNARVRIAYPSLREAAL (MAGA4_HUMAN)
  Core: VRIAYPSLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARXRIXYXSLXEAAL

SEQ ID NO: 246242 - protein, 24 aa, Artificial Sequence
  Description of Artificial Sequence: Synthetic peptide
  Seed: VLEHVVRVNARVRIAYPSLREAAL (MAGA4_HUMAN)
  Core: RIAYPSLRE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVXIAXPXLRXAAL

SEQ ID NO: 246243 - protein, 24 aa, Artificial Sequence
  Description of Artificial Sequence: Synthetic peptide
  Seed: VLEHVVRVNARVRIAYPSLREAAL (MAGA4_HUMAN)
  Core: IAYPSLREA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVRXAYXSXREXAL

SEQ ID NO: 246244 - protein, 25 aa, Artificial Sequence
  Description of Artificial Sequence: Synthetic peptide
  Seed: VLEHVVRVNARVRIAYPSLREAALL (MAGA4_HUMAN)
  Core: VRVNARVRI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVXRVXAXVRXAYPSLREAALL

SEQ ID NO: 246245 - protein, 25 aa, Artificial Sequence
  Description of Artificial Sequence: Synthetic peptide
  Seed: VLEHVVRVNARVRIAYPSLREAALL (MAGA4_HUMAN)
  Core: RVNARVRIA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVXVNXRXRIXYPSLREAALL

SEQ ID NO: 246246 - protein, 25 aa, Artificial Sequence
  Description of Artificial Sequence: Synthetic peptide
  Seed: VLEHVVRVNARVRIAYPSLREAALL (MAGA4_HUMAN)
  Core: NARVRIAYP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVXARXRXAYXSLREAALL

SEQ ID NO: 246247 - protein, 25 aa, Artificial Sequence
  Description of Artificial Sequence: Synthetic peptide
  Seed: VLEHVVRVNARVRIAYPSLREAALL (MAGA4_HUMAN)
  Core: ARVRIAYPS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNXRVXIXYPXLREAALL

SEQ ID NO: 246248 - protein, 25 aa, Artificial Sequence
  Description of Artificial Sequence: Synthetic peptide
  Seed: VLEHVVRVNARVRIAYPSLREAALL (MAGA4_HUMAN)
  Core: RVRIAYPSL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNAXVRXAXPSXREAALL

SEQ ID NO: 246249 - protein, 25 aa, Artificial Sequence
  Description of Artificial Sequence: Synthetic peptide
  Seed: VLEHVVRVNARVRIAYPSLREAALL (MAGA4_HUMAN)
  Core: VRIAYPSLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARXRIXYXSLXEAALL

SEQ ID NO: 246250 - protein, 25 aa, Artificial Sequence
  Description of Artificial Sequence: Synthetic peptide
  Seed: VLEHVVRVNARVRIAYPSLREAALL (MAGA4_HUMAN)
  Core: RIAYPSLRE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVXIAXPXLRXAALL

SEQ ID NO: 246251 - protein, 25 aa, Artificial Sequence
  Description of Artificial Sequence: Synthetic peptide
  Seed: VLEHVVRVNARVRIAYPSLREAALL (MAGA4_HUMAN)
  Core: IAYPSLREA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLEHVVRVNARVRXAYXSXREXALL

SEQ ID NO: 246252 - protein, 14 aa, Artificial Sequence
  Description of Artificial Sequence: Synthetic peptide
  Seed: VLGTIAMEGDSASE (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXE

SEQ ID NO: 246253 - protein, 15 aa, Artificial Sequence
  Description of Artificial Sequence: Synthetic peptide
  Seed: VLGTIAMEGDSASEE (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEE

SEQ ID NO: 246254 - protein, 16 aa, Artificial Sequence
  Description of Artificial Sequence: Synthetic peptide
  Seed: VLGTIAMEGDSASEEE (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEE

SEQ ID NO: 246255 - protein, 16 aa, Artificial Sequence
  Description of Artificial Sequence: Synthetic peptide
  Seed: VLGTIAMEGDSASEEE (MAGA4_HUMAN)
  Core: MEGDSASEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLGTIAXEGXSXSEXE

SEQ ID NO: 246256 - protein, 17 aa, Artificial Sequence
  Description of Artificial Sequence: Synthetic peptide
  Seed: VLGTIAMEGDSASEEEI (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEI

SEQ ID NO: 246257 - protein, 19 aa, Artificial Sequence
  Description of Artificial Sequence: Synthetic peptide
  Seed: VLGTIAMEGDSASEEEIWE (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWE

SEQ ID NO: 246258 - protein, 20 aa, Artificial Sequence
  Description of Artificial Sequence: Synthetic peptide
  Seed: VLGTIAMEGDSASEEEIWEE (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEE

SEQ ID NO: 246259 - protein, 21 aa, Artificial Sequence
  Description of Artificial Sequence: Synthetic peptide
  Seed: VLGTIAMEGDSASEEEIWEEL (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEEL

SEQ ID NO: 246260 - protein, 22 aa, Artificial Sequence
  Description of Artificial Sequence: Synthetic peptide
  Seed: VLGTIAMEGDSASEEEIWEELG (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEELG

SEQ ID NO: 246261 - protein, 23 aa, Artificial Sequence
  Description of Artificial Sequence: Synthetic peptide
  Seed: VLGTIAMEGDSASEEEIWEELGV (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEELGV

SEQ ID NO: 246262 - protein, 24 aa, Artificial Sequence
  Description of Artificial Sequence: Synthetic peptide
  Seed: VLGTIAMEGDSASEEEIWEELGVM (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEELGVM

SEQ ID NO: 246263 - protein, 25 aa, Artificial Sequence
  Description of Artificial Sequence: Synthetic peptide
  Seed: VLGTIAMEGDSASEEEIWEELGVMG (MAGA4_HUMAN)
  Core: IAMEGDSAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGTXAMXGXSAXEEEIWEELGVMG

SEQ ID NO: 246264 - protein, 25 aa, Artificial Sequence
  Description of Artificial Sequence: Synthetic peptide
  Seed: VLGTIAMEGDSASEEEIWEELGVMG (MAGA4_HUMAN)
  Core: MEGDSASEE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLGTIAXEGXSXSEXEIWEELGVMG

SEQ ID NO: 246265 - protein, 14 aa, Artificial Sequence
  Description of Artificial Sequence: Synthetic peptide
  Seed: VNARVRIAYPSLRE (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXRE

SEQ ID NO: 246266 - protein, 14 aa, Artificial Sequence
  Description of Artificial Sequence: Synthetic peptide
  Seed: VNARVRIAYPSLRE (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXE

SEQ ID NO: 246267 - protein, 15 aa, Artificial Sequence
  Description of Artificial Sequence: Synthetic peptide
  Seed: VNARVRIAYPSLREA (MAGA4_HUMAN)
  Core: ARVRIAYPS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VNXRVXIXYPXLREA

SEQ ID NO: 246268 - protein, 15 aa, Artificial Sequence
  Description of Artificial Sequence: Synthetic peptide
  Seed: VNARVRIAYPSLREA (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREA

SEQ ID NO: 246269 - protein, 15 aa, Artificial Sequence
  Description of Artificial Sequence: Synthetic peptide
  Seed: VNARVRIAYPSLREA (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEA

SEQ ID NO: 246270 - protein, 15 aa, Artificial Sequence
  Description of Artificial Sequence: Synthetic peptide
  Seed: VNARVRIAYPSLREA (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXA

SEQ ID NO: 246271 - protein, 15 aa, Artificial Sequence
  Description of Artificial Sequence: Synthetic peptide
  Seed: VNARVRIAYPSLREA (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREX

SEQ ID NO: 246272 - protein, 16 aa, Artificial Sequence
  Description of Artificial Sequence: Synthetic peptide
  Seed: VNARVRIAYPSLREAA (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAA

SEQ ID NO: 246273 - protein, 16 aa, Artificial Sequence
  Description of Artificial Sequence: Synthetic peptide
  Seed: VNARVRIAYPSLREAA (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAA

SEQ ID NO: 246274 - protein, 16 aa, Artificial Sequence
  Description of Artificial Sequence: Synthetic peptide
  Seed: VNARVRIAYPSLREAA (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAA

SEQ ID NO: 246275 - protein, 16 aa, Artificial Sequence
  Description of Artificial Sequence: Synthetic peptide
  Seed: VNARVRIAYPSLREAA (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXA

SEQ ID NO: 246276 - protein, 17 aa, Artificial Sequence
  Description of Artificial Sequence: Synthetic peptide
  Seed: VNARVRIAYPSLREAAL (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAAL

SEQ ID NO: 246277 - protein, 17 aa, Artificial Sequence
  Description of Artificial Sequence: Synthetic peptide
  Seed: VNARVRIAYPSLREAAL (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAAL

SEQ ID NO: 246278 - protein, 17 aa, Artificial Sequence
  Description of Artificial Sequence: Synthetic peptide
  Seed: VNARVRIAYPSLREAAL (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAAL

SEQ ID NO: 246279 - protein, 17 aa, Artificial Sequence
  Description of Artificial Sequence: Synthetic peptide
  Seed: VNARVRIAYPSLREAAL (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXAL

SEQ ID NO: 246280 - protein, 18 aa, Artificial Sequence
  Description of Artificial Sequence: Synthetic peptide
  Seed: VNARVRIAYPSLREAALL (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALL

SEQ ID NO: 246281 - protein, 18 aa, Artificial Sequence
  Description of Artificial Sequence: Synthetic peptide
  Seed: VNARVRIAYPSLREAALL (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALL

SEQ ID NO: 246282 - protein, 18 aa, Artificial Sequence
  Description of Artificial Sequence: Synthetic peptide
  Seed: VNARVRIAYPSLREAALL (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALL

SEQ ID NO: 246283 - protein, 18 aa, Artificial Sequence
  Description of Artificial Sequence: Synthetic peptide
  Seed: VNARVRIAYPSLREAALL (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALL

SEQ ID NO: 246284 - protein, 19 aa, Artificial Sequence
  Description of Artificial Sequence: Synthetic peptide
  Seed: VNARVRIAYPSLREAALLE (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLE

SEQ ID NO: 246285 - protein, 19 aa, Artificial Sequence
  Description of Artificial Sequence: Synthetic peptide
  Seed: VNARVRIAYPSLREAALLE (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLE

SEQ ID NO: 246286 - protein, 19 aa, Artificial Sequence
  Description of Artificial Sequence: Synthetic peptide
  Seed: VNARVRIAYPSLREAALLE (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLE

SEQ ID NO: 246287 - protein, 19 aa, Artificial Sequence
  Description of Artificial Sequence: Synthetic peptide
  Seed: VNARVRIAYPSLREAALLE (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLE

SEQ ID NO: 246288 - protein, 20 aa, Artificial Sequence
  Description of Artificial Sequence: Synthetic peptide
  Seed: VNARVRIAYPSLREAALLEE (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLEE

SEQ ID NO: 246289 - protein, 20 aa, Artificial Sequence
  Description of Artificial Sequence: Synthetic peptide
  Seed: VNARVRIAYPSLREAALLEE (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLEE

SEQ ID NO: 246290 - protein, 20 aa, Artificial Sequence
  Description of Artificial Sequence: Synthetic peptide
  Seed: VNARVRIAYPSLREAALLEE (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLEE

SEQ ID NO: 246291 - protein, 20 aa, Artificial Sequence
  Description of Artificial Sequence: Synthetic peptide
  Seed: VNARVRIAYPSLREAALLEE (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLEE

SEQ ID NO: 246292 - protein, 21 aa, Artificial Sequence
  Description of Artificial Sequence: Synthetic peptide
  Seed: VNARVRIAYPSLREAALLEEE (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLEEE

SEQ ID NO: 246293 - protein, 21 aa, Artificial Sequence
  Description of Artificial Sequence: Synthetic peptide
  Seed: VNARVRIAYPSLREAALLEEE (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLEEE

SEQ ID NO: 246294 - protein, 21 aa, Artificial Sequence
  Description of Artificial Sequence: Synthetic peptide
  Seed: VNARVRIAYPSLREAALLEEE (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLEEE

SEQ ID NO: 246295 - protein, 21 aa, Artificial Sequence
  Description of Artificial Sequence: Synthetic peptide
  Seed: VNARVRIAYPSLREAALLEEE (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLEEE

SEQ ID NO: 246296 - protein, 21 aa, Artificial Sequence
  Description of Artificial Sequence: Synthetic peptide
  Seed: VNARVRIAYPSLREAALLEEE (MAGA4_HUMAN)
  Core: YPSLREAAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAXPSXRXAAXLEEE

SEQ ID NO: 246297 - protein, 21 aa, Artificial Sequence
  Description of Artificial Sequence: Synthetic peptide
  Seed: VNARVRIAYPSLREAALLEEE (MAGA4_HUMAN)
  Core: LREAALLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSXREXAXLEXE

SEQ ID NO: 246298 - protein, 21 aa, Artificial Sequence
  Description of Artificial Sequence: Synthetic peptide
  Seed: VNARVRIAYPSLREAALLEEE (MAGA4_HUMAN)
  Core: REAALLEEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSLXEAXLXEEX

SEQ ID NO: 246299 - protein, 22 aa, Artificial Sequence
  Description of Artificial Sequence: Synthetic peptide
  Seed: VNARVRIAYPSLREAALLEEEE (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLEEEE

SEQ ID NO: 246300 - protein, 22 aa, Artificial Sequence
  Description of Artificial Sequence: Synthetic peptide
  Seed: VNARVRIAYPSLREAALLEEEE (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLEEEE

SEQ ID NO: 246301 - protein, 22 aa, Artificial Sequence
  Description of Artificial Sequence: Synthetic peptide
  Seed: VNARVRIAYPSLREAALLEEEE (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLEEEE

SEQ ID NO: 246302 - protein, 22 aa, Artificial Sequence
  Description of Artificial Sequence: Synthetic peptide
  Seed: VNARVRIAYPSLREAALLEEEE (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLEEEE

SEQ ID NO: 246303 - protein, 22 aa, Artificial Sequence
  Description of Artificial Sequence: Synthetic peptide
  Seed: VNARVRIAYPSLREAALLEEEE (MAGA4_HUMAN)
  Core: YPSLREAAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAXPSXRXAAXLEEEE

SEQ ID NO: 246304 - protein, 22 aa, Artificial Sequence
  Description of Artificial Sequence: Synthetic peptide
  Seed: VNARVRIAYPSLREAALLEEEE (MAGA4_HUMAN)
  Core: LREAALLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSXREXAXLEXEE

SEQ ID NO: 246305 - protein, 22 aa, Artificial Sequence
  Description of Artificial Sequence: Synthetic peptide
  Seed: VNARVRIAYPSLREAALLEEEE (MAGA4_HUMAN)
  Core: REAALLEEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSLXEAXLXEEXE

SEQ ID NO: 246306 - protein, 23 aa, Artificial Sequence
  Description of Artificial Sequence: Synthetic peptide
  Seed: VNARVRIAYPSLREAALLEEEEG (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLEEEEG

SEQ ID NO: 246307 - protein, 23 aa, Artificial Sequence
  Description of Artificial Sequence: Synthetic peptide
  Seed: VNARVRIAYPSLREAALLEEEEG (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLEEEEG

SEQ ID NO: 246308 - protein, 23 aa, Artificial Sequence
  Description of Artificial Sequence: Synthetic peptide
  Seed: VNARVRIAYPSLREAALLEEEEG (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLEEEEG

SEQ ID NO: 246309 - protein, 23 aa, Artificial Sequence
  Description of Artificial Sequence: Synthetic peptide
  Seed: VNARVRIAYPSLREAALLEEEEG (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLEEEEG

SEQ ID NO: 246310 - protein, 23 aa, Artificial Sequence
  Description of Artificial Sequence: Synthetic peptide
  Seed: VNARVRIAYPSLREAALLEEEEG (MAGA4_HUMAN)
  Core: YPSLREAAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAXPSXRXAAXLEEEEG

SEQ ID NO: 246311 - protein, 23 aa, Artificial Sequence
  Description of Artificial Sequence: Synthetic peptide
  Seed: VNARVRIAYPSLREAALLEEEEG (MAGA4_HUMAN)
  Core: LREAALLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSXREXAXLEXEEG

SEQ ID NO: 246312 - protein, 23 aa, Artificial Sequence
  Description of Artificial Sequence: Synthetic peptide
  Seed: VNARVRIAYPSLREAALLEEEEG (MAGA4_HUMAN)
  Core: REAALLEEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSLXEAXLXEEXEG

SEQ ID NO: 246313 - protein, 24 aa, Artificial Sequence
  Description of Artificial Sequence: Synthetic peptide
  Seed: VNARVRIAYPSLREAALLEEEEGV (MAGA4_HUMAN)
  Core: RVRIAYPSL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VNAXVRXAXPSXREAALLEEEEGV

SEQ ID NO: 246314 - protein, 24 aa, Artificial Sequence
  Description of Artificial Sequence: Synthetic peptide
  Seed: VNARVRIAYPSLREAALLEEEEGV (MAGA4_HUMAN)
  Core: VRIAYPSLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VNARXRIXYXSLXEAALLEEEEGV

SEQ ID NO: 246315 - protein, 24 aa, Artificial Sequence
  Description of Artificial Sequence: Synthetic peptide
  Seed: VNARVRIAYPSLREAALLEEEEGV (MAGA4_HUMAN)
  Core: RIAYPSLRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNARVXIAXPXLRXAALLEEEEGV

SEQ ID NO: 246316 - protein, 24 aa, Artificial Sequence
  Description of Artificial Sequence: Synthetic peptide
  Seed: VNARVRIAYPSLREAALLEEEEGV (MAGA4_HUMAN)
  Core: IAYPSLREA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRXAYXSXREXALLEEEEGV

SEQ ID NO: 246317 - protein, 24 aa, Artificial Sequence
  Description of Artificial Sequence: Synthetic peptide
  Seed: VNARVRIAYPSLREAALLEEEEGV (MAGA4_HUMAN)
  Core: YPSLREAAL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAXPSXRXAAXLEEEEGV

SEQ ID NO: 246318 - protein, 24 aa, Artificial Sequence
  Description of Artificial Sequence: Synthetic peptide
  Seed: VNARVRIAYPSLREAALLEEEEGV (MAGA4_HUMAN)
  Core: LREAALLEE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSXREXAXLEXEEGV

SEQ ID NO: 246319 - protein, 24 aa, Artificial Sequence
  Description of Artificial Sequence: Synthetic peptide
  Seed: VNARVRIAYPSLREAALLEEEEGV (MAGA4_HUMAN)
  Core: REAALLEEE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VNARVRIAYPSLXEAXLXEEXEGV

SEQ ID NO: 246320 - protein, 14 aa, Artificial Sequence
  Description of Artificial Sequence: Synthetic peptide
  Seed: VPAAESAGPPQSPQ (MAGA4_HUMAN)
  Core: AESAGPPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPAXESXGXPQXPQ

SEQ ID NO: 246321 - protein, 15 aa, Artificial Sequence
  Description of Artificial Sequence: Synthetic peptide
  Seed: VPAAESAGPPQSPQG (MAGA4_HUMAN)
  Core: AESAGPPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPAXESXGXPQXPQG

SEQ ID NO: 246322 - protein, 16 aa, Artificial Sequence
  Description of Artificial Sequence: Synthetic peptide
  Seed: VPAAESAGPPQSPQGA (MAGA4_HUMAN)
  Core: AESAGPPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPAXESXGXPQXPQGA

SEQ ID NO: 246323 - protein, 17 aa, Artificial Sequence
  Description of Artificial Sequence: Synthetic peptide
  Seed: VPAAESAGPPQSPQGAS (MAGA4_HUMAN)
  Core: AESAGPPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPAXESXGXPQXPQGAS

SEQ ID NO: 246324 - protein, 20 aa, Artificial Sequence
  Description of Artificial Sequence: Synthetic peptide
  Seed: VPAAESAGPPQSPQGASALP (MAGA4_HUMAN)
  Core: AESAGPPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPAXESXGXPQXPQGASALP

SEQ ID NO: 246325 - protein, 21 aa, Artificial Sequence
  Description of Artificial Sequence: Synthetic peptide
  Seed: VPAAESAGPPQSPQGASALPT (MAGA4_HUMAN)
  Core: PQGASALPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPAAESAGPPQSXQGXSXLPX

SEQ ID NO: 246326 - protein, 22 aa, Artificial Sequence
  Description of Artificial Sequence: Synthetic peptide
  Seed: VPAAESAGPPQSPQGASALPTT (MAGA4_HUMAN)
  Core: PQGASALPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPAAESAGPPQSXQGXSXLPXT

SEQ ID NO: 246327 - protein, 23 aa, Artificial Sequence
  Description of Artificial Sequence: Synthetic peptide
  Seed: VPAAESAGPPQSPQGASALPTTI (MAGA4_HUMAN)
  Core: PQGASALPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPAAESAGPPQSXQGXSXLPXTI

SEQ ID NO: 246328 - protein, 24 aa, Artificial Sequence
  Description of Artificial Sequence: Synthetic peptide
  Seed: VPAAESAGPPQSPQGASALPTTIS (MAGA4_HUMAN)
  Core: PQGASALPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPAAESAGPPQSXQGXSXLPXTIS

SEQ ID NO: 246329 - protein, 25 aa, Artificial Sequence
  Description of Artificial Sequence: Synthetic peptide
  Seed: VPAAESAGPPQSPQGASALPTTISF (MAGA4_HUMAN)
  Core: PQGASALPT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPAAESAGPPQSXQGXSXLPXTISF

SEQ ID NO: 246330 - protein, 17 aa, Artificial Sequence
  Description of Artificial Sequence: Synthetic peptide
  Seed: VPGSNPARYEFLWGPRA (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRX

SEQ ID NO: 246331 - protein, 18 aa, Artificial Sequence
  Description of Artificial Sequence: Synthetic peptide
  Seed: VPGSNPARYEFLWGPRAL (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXL

SEQ ID NO: 246332 - protein, 19 aa, Artificial Sequence
  Description of Artificial Sequence: Synthetic peptide
  Seed: VPGSNPARYEFLWGPRALA (MAGA4_HUMAN)
  Core: ARYEFLWGP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPXRYXFXWGXRALA

SEQ ID NO: 246333 - protein, 19 aa, Artificial Sequence
  Description of Artificial Sequence: Synthetic peptide
  Seed: VPGSNPARYEFLWGPRALA (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLA

SEQ ID NO: 246334 - protein, 20 aa, Artificial Sequence
  Description of Artificial Sequence: Synthetic peptide
  Seed: VPGSNPARYEFLWGPRALAE (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAE

SEQ ID NO: 246335 - protein, 20 aa, Artificial Sequence
  Description of Artificial Sequence: Synthetic peptide
  Seed: VPGSNPARYEFLWGPRALAE (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXE

SEQ ID NO: 246336 - protein, 21 aa, Artificial Sequence
  Description of Artificial Sequence: Synthetic peptide
  Seed: VPGSNPARYEFLWGPRALAET (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAET

SEQ ID NO: 246337 - protein, 21 aa, Artificial Sequence
  Description of Artificial Sequence: Synthetic peptide
  Seed: VPGSNPARYEFLWGPRALAET (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXET

SEQ ID NO: 246338 - protein, 22 aa, Artificial Sequence
  Description of Artificial Sequence: Synthetic peptide
  Seed: VPGSNPARYEFLWGPRALAETS (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAETS

SEQ ID NO: 246339 - protein, 22 aa, Artificial Sequence
  Description of Artificial Sequence: Synthetic peptide
  Seed: VPGSNPARYEFLWGPRALAETS (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXETS

SEQ ID NO: 246340 - protein, 22 aa, Artificial Sequence
  Description of Artificial Sequence: Synthetic peptide
  Seed: VPGSNPARYEFLWGPRALAETS (MAGA4_HUMAN)
  Core: LWGPRALAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEFXWGXRXLAXTS

SEQ ID NO: 246341 - protein, 23 aa, Artificial Sequence
  Description of Artificial Sequence: Synthetic peptide
  Seed: VPGSNPARYEFLWGPRALAETSY (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAETSY

SEQ ID NO: 246342 - protein, 23 aa, Artificial Sequence
  Description of Artificial Sequence: Synthetic peptide
  Seed: VPGSNPARYEFLWGPRALAETSY (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXETSY

SEQ ID NO: 246343 - protein, 23 aa, Artificial Sequence
  Description of Artificial Sequence: Synthetic peptide
  Seed: VPGSNPARYEFLWGPRALAETSY (MAGA4_HUMAN)
  Core: LWGPRALAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEFXWGXRXLAXTSY

SEQ ID NO: 246344 - protein, 24 aa, Artificial Sequence
  Description of Artificial Sequence: Synthetic peptide
  Seed: VPGSNPARYEFLWGPRALAETSYV (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAETSYV

SEQ ID NO: 246345 - protein, 24 aa, Artificial Sequence
  Description of Artificial Sequence: Synthetic peptide
  Seed: VPGSNPARYEFLWGPRALAETSYV (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXETSYV

SEQ ID NO: 246346 - protein, 24 aa, Artificial Sequence
  Description of Artificial Sequence: Synthetic peptide
  Seed: VPGSNPARYEFLWGPRALAETSYV (MAGA4_HUMAN)
  Core: LWGPRALAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEFXWGXRXLAXTSYV

SEQ ID NO: 246347 - protein, 25 aa, Artificial Sequence
  Description of Artificial Sequence: Synthetic peptide
  Seed: VPGSNPARYEFLWGPRALAETSYVK (MAGA4_HUMAN)
  Core: YEFLWGPRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARXEFXWXPRXLAETSYVK

SEQ ID NO: 246348 - protein, 25 aa, Artificial Sequence
  Description of Artificial Sequence: Synthetic peptide
  Seed: VPGSNPARYEFLWGPRALAETSYVK (MAGA4_HUMAN)
  Core: FLWGPRALA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEXLWXPXALXETSYVK

SEQ ID NO: 246349 - protein, 25 aa, Artificial Sequence
  Description of Artificial Sequence: Synthetic peptide
  Seed: VPGSNPARYEFLWGPRALAETSYVK (MAGA4_HUMAN)
  Core: LWGPRALAE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEFXWGXRXLAXTSYVK

SEQ ID NO: 246350 - protein, 25 aa, Artificial Sequence
  Description of Artificial Sequence: Synthetic peptide
  Seed: VPGSNPARYEFLWGPRALAETSYVK (MAGA4_HUMAN)
  Core: RALAETSYV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VPGSNPARYEFLWGPXALXEXSYXK

SEQ ID NO: 246351 - protein, 19 aa, Artificial Sequence
  Description of Artificial Sequence: Synthetic peptide
  Seed: VPGTLEEVPAAESAGPPQS (MAGA4_HUMAN)
  Core: LEEVPAAES
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPGTXEEXPXAEXAGPPQS

SEQ ID NO: 246352 - protein, 20 aa, Artificial Sequence
  Description of Artificial Sequence: Synthetic peptide
  Seed: VPGTLEEVPAAESAGPPQSP (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXP

SEQ ID NO: 246353 - protein, 21 aa, Artificial Sequence
  Description of Artificial Sequence: Synthetic peptide
  Seed: VPGTLEEVPAAESAGPPQSPQ (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXPQ

SEQ ID NO: 246354 - protein, 22 aa, Artificial Sequence
  Description of Artificial Sequence: Synthetic peptide
  Seed: VPGTLEEVPAAESAGPPQSPQG (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXPQG

SEQ ID NO: 246355 - protein, 23 aa, Artificial Sequence
  Description of Artificial Sequence: Synthetic peptide
  Seed: VPGTLEEVPAAESAGPPQSPQGA (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXPQGA

SEQ ID NO: 246356 - protein, 24 aa, Artificial Sequence
  Description of Artificial Sequence: Synthetic peptide
  Seed: VPGTLEEVPAAESAGPPQSPQGAS (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXPQGAS

SEQ ID NO: 246357 - protein, 25 aa, Artificial Sequence
  Description of Artificial Sequence: Synthetic peptide
  Seed: VPGTLEEVPAAESAGPPQSPQGASA (MAGA4_HUMAN)
  Core: AESAGPPQS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPGTLEEVPAXESXGXPQXPQGASA

SEQ ID NO: 246358 - protein, 17 aa, Artificial Sequence
  Description of Artificial Sequence: Synthetic peptide
  Seed: VQENYLEYRQVPGSNPA (MAGA4_HUMAN)
  Core: YLEYRQVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VQENXLEXRXVPXSNPA

SEQ ID NO: 246359 - protein, 19 aa, Artificial Sequence
  Description of Artificial Sequence: Synthetic peptide
  Seed: VQENYLEYRQVPGSNPARY (MAGA4_HUMAN)
  Core: YLEYRQVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VQENXLEXRXVPXSNPARY

SEQ ID NO: 246360 - protein, 19 aa, Artificial Sequence
  Description of Artificial Sequence: Synthetic peptide
  Seed: VQENYLEYRQVPGSNPARY (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARY

SEQ ID NO: 246361 - protein, 20 aa, Artificial Sequence
  Description of Artificial Sequence: Synthetic peptide
  Seed: VQENYLEYRQVPGSNPARYE (MAGA4_HUMAN)
  Core: YLEYRQVPG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VQENXLEXRXVPXSNPARYE

SEQ ID NO: 246362 - protein, 20 aa, Artificial Sequence
  Description of Artificial Sequence: Synthetic peptide
  Seed: VQENYLEYRQVPGSNPARYE (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYE

SEQ ID NO: 246363 - protein, 21 aa, Artificial Sequence
  Description of Artificial Sequence: Synthetic peptide
  Seed: VQENYLEYRQVPGSNPARYEF (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYEF

SEQ ID NO: 246364 - protein, 22 aa, Artificial Sequence
  Description of Artificial Sequence: Synthetic peptide
  Seed: VQENYLEYRQVPGSNPARYEFL (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYEFL

SEQ ID NO: 246365 - protein, 23 aa, Artificial Sequence
  Description of Artificial Sequence: Synthetic peptide
  Seed: VQENYLEYRQVPGSNPARYEFLW (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYEFLW

SEQ ID NO: 246366 - protein, 24 aa, Artificial Sequence
  Description of Artificial Sequence: Synthetic peptide
  Seed: VQENYLEYRQVPGSNPARYEFLWG (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYEFLWG

SEQ ID NO: 246367 - protein, 25 aa, Artificial Sequence
  Description of Artificial Sequence: Synthetic peptide
  Seed: VQENYLEYRQVPGSNPARYEFLWGP (MAGA4_HUMAN)
  Core: YRQVPGSNP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQENYLEXRQXPXSNXARYEFLWGP

SEQ ID NO: 246368 - protein, 14 aa, Artificial Sequence
  Description of Artificial Sequence: Synthetic peptide
  Seed: VRIAYPSLREAALL (MAGA4_HUMAN)
  Core: VRIAYPSLR
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRIXYXSLXEAALL

SEQ ID NO: 246369 - protein, 14 aa, Artificial Sequence
  Description of Artificial Sequence: Synthetic peptide
  Seed: VRIAYPSLREAALL (MAGA4_HUMAN)
  Core: RIAYPSLRE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXIAXPXLRXAALL

SEQ ID NO: 246370 - protein, 14 aa, Artificial Sequence
  Description of Artificial Sequence: Synthetic peptide
  Seed: VRIAYPSLREAALL (MAGA4_HUMAN)
  Core: IAYPSLREA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXAYXSXREXALL

SEQ ID NO: 246371 - protein, 14 aa, Artificial Sequence
  Description of Artificial Sequence: Synthetic peptide
  Seed: VRIAYPSLREAALL (MAGA4_HUMAN)
  Core: YPSLREAAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRIAXPSXRXAAXL

SEQ ID NO: 246372 - protein, 15 aa, Artificial Sequence
  Description of Artificial Sequence: Synthetic peptide
  Seed: VRIAYPSLREAALLE (MAGA4_HUMAN)
  Core: VRIAYPSLR
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRIXYXSLXEAALLE

SEQ ID NO: 246373 - protein, 15 aa, Artificial Sequence
  Description of Artificial Sequence: Synthetic peptide
  Seed: VRIAYPSLREAALLE (MAGA4_HUMAN)
  Core: RIAYPSLRE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXIAXPXLRXAALLE

SEQ ID NO: 246374 - protein, 15 aa, Artificial Sequence
  Description of Artificial Sequence: Synthetic peptide
  Seed: VRIAYPSLREAALLE (MAGA4_HUMAN)
  Core: IAYPSLREA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXAYXSXREXALLE

SEQ ID NO: 246375 - protein, 15 aa, Artificial Sequence
  Description of Artificial Sequence: Synthetic peptide
  Seed: VRIAYPSLREAALLE (MAGA4_HUMAN)
  Core: AYPSLREAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRIXYPXLXEAXLLE

SEQ ID NO: 246376 - protein, 15 aa, Artificial Sequence
  Description of Artificial Sequence: Synthetic peptide
  Seed: VRIAYPSLREAALLE (MAGA4_HUMAN)
  Core: YPSLREAAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRIAXPSXRXAAXLE

SEQ ID NO: 246377 - protein, 16 aa, Artificial Sequence
  Description of Artificial Sequence: Synthetic peptide
  Seed: VRIAYPSLREAALLEE (MAGA4_HUMAN)
  Core: VRIAYPSLR
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XRIXYXSLXEAALLEE

SEQ ID NO: 246378 - protein, 16 aa, Artificial Sequence
  Description of Artificial Sequence: Synthetic peptide
  Seed: VRIAYPSLREAALLEE (MAGA4_HUMAN)
  Core: RIAYPSLRE
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXIAXPXLRXAALLEE

SEQ ID NO: 246379 - protein, 16 aa, Artificial Sequence
  Description of Artificial Sequence: Synthetic peptide
  Seed: VRIAYPSLREAALLEE (MAGA4_HUMAN)
  Core: IAYPSLREA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXAYXSXREXALLEE

SEQ ID NO: 246380 - protein, 16 aa, Artificial Sequence
  Description of Artificial Sequence: Synthetic peptide
  Seed: VRIAYPSLREAALLEE (MAGA4_HUMAN)
  Core: YPSLREAAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRIAXPSXRXAAXLEE

SEQ ID NO: 246381 - protein, 16 aa, Artificial Sequence
  Description of Artificial Sequence: Synthetic peptide
  Seed: VRIAYPSLREAALLEE (MAGA4_HUMAN)
  Core: LREAALLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSXREXAXLEX

SEQ ID NO: 246382 - protein, 17 aa, Artificial Sequence
  Description of Artificial Sequence: Synthetic peptide
  Seed: VRIAYPSLREAALLEEE (MAGA4_HUMAN)
  Core: IAYPSLREA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXAYXSXREXALLEEE

SEQ ID NO: 246383 - protein, 17 aa, Artificial Sequence
  Description of Artificial Sequence: Synthetic peptide
  Seed: VRIAYPSLREAALLEEE (MAGA4_HUMAN)
  Core: AYPSLREAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRIXYPXLXEAXLLEEE

SEQ ID NO: 246384 - protein, 17 aa, Artificial Sequence
  Description of Artificial Sequence: Synthetic peptide
  Seed: VRIAYPSLREAALLEEE (MAGA4_HUMAN)
  Core: YPSLREAAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRIAXPSXRXAAXLEEE

SEQ ID NO: 246385 - protein, 17 aa, Artificial Sequence
  Description of Artificial Sequence: Synthetic peptide
  Seed: VRIAYPSLREAALLEEE (MAGA4_HUMAN)
  Core: LREAALLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSXREXAXLEXE

SEQ ID NO: 246386 - protein, 17 aa, Artificial Sequence
  Description of Artificial Sequence: Synthetic peptide
  Seed: VRIAYPSLREAALLEEE (MAGA4_HUMAN)
  Core: REAALLEEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSLXEAXLXEEX

SEQ ID NO: 246387 - protein, 18 aa, Artificial Sequence
  Description of Artificial Sequence: Synthetic peptide
  Seed: VRIAYPSLREAALLEEEE (MAGA4_HUMAN)
  Core: LREAALLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSXREXAXLEXEE

SEQ ID NO: 246388 - protein, 18 aa, Artificial Sequence
  Description of Artificial Sequence: Synthetic peptide
  Seed: VRIAYPSLREAALLEEEE (MAGA4_HUMAN)
  Core: REAALLEEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSLXEAXLXEEXE

SEQ ID NO: 246389 - protein, 19 aa, Artificial Sequence
  Description of Artificial Sequence: Synthetic peptide
  Seed: VRIAYPSLREAALLEEEEG (MAGA4_HUMAN)
  Core: LREAALLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSXREXAXLEXEEG

SEQ ID NO: 246390 - protein, 19 aa, Artificial Sequence
  Description of Artificial Sequence: Synthetic peptide
  Seed: VRIAYPSLREAALLEEEEG (MAGA4_HUMAN)
  Core: REAALLEEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSLXEAXLXEEXEG

SEQ ID NO: 246391 - protein, 20 aa, Artificial Sequence
  Description of Artificial Sequence: Synthetic peptide
  Seed: VRIAYPSLREAALLEEEEGV (MAGA4_HUMAN)
  Core: YPSLREAAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRIAXPSXRXAAXLEEEEGV

SEQ ID NO: 246392 - protein, 20 aa, Artificial Sequence
  Description of Artificial Sequence: Synthetic peptide
  Seed: VRIAYPSLREAALLEEEEGV (MAGA4_HUMAN)
  Core: LREAALLEE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSXREXAXLEXEEGV

SEQ ID NO: 246393 - protein, 20 aa, Artificial Sequence
  Description of Artificial Sequence: Synthetic peptide
  Seed: VRIAYPSLREAALLEEEEGV (MAGA4_HUMAN)
  Core: REAALLEEE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRIAYPSLXEAXLXEEXEGV

SEQ ID NO: 246394 - protein, 13 aa, Artificial Sequence
  Description of Artificial Sequence: Synthetic peptide
  Seed: VRVNARVRIAYPS (MAGA4_HUMAN)
  Core: VNARVRIAY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXNAXVXIAXPS

SEQ ID NO: 246395 - protein, 14 aa, Artificial Sequence
  Description of Artificial Sequence: Synthetic peptide
  Seed: VRVNARVRIAYPSL (MAGA4_HUMAN)
  Core: RVNARVRIA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVNXRXRIXYPSL

SEQ ID NO: 246396 - protein, 14 aa, Artificial Sequence
  Description of Artificial Sequence: Synthetic peptide
  Seed: VRVNARVRIAYPSL (MAGA4_HUMAN)
  Core: VNARVRIAY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXNAXVXIAXPSL

SEQ ID NO: 246397 - protein, 14 aa, Artificial Sequence
  Description of Artificial Sequence: Synthetic peptide
  Seed: VRVNARVRIAYPSL (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSL

SEQ ID NO: 246398 - protein, 14 aa, Artificial Sequence
  Description of Artificial Sequence: Synthetic peptide
  Seed: VRVNARVRIAYPSL (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXL

SEQ ID NO: 246399 - protein, 15 aa, Artificial Sequence
  Description of Artificial Sequence: Synthetic peptide
  Seed: VRVNARVRIAYPSLR (MAGA4_HUMAN)
  Core: RVNARVRIA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVNXRXRIXYPSLR

SEQ ID NO: 246400 - protein, 15 aa, Artificial Sequence
  Description of Artificial Sequence: Synthetic peptide
  Seed: VRVNARVRIAYPSLR (MAGA4_HUMAN)
  Core: VNARVRIAY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXNAXVXIAXPSLR

SEQ ID NO: 246401 - protein, 15 aa, Artificial Sequence
  Description of Artificial Sequence: Synthetic peptide
  Seed: VRVNARVRIAYPSLR (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSLR

SEQ ID NO: 246402 - protein, 15 aa, Artificial Sequence
  Description of Artificial Sequence: Synthetic peptide
  Seed: VRVNARVRIAYPSLR (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLR

SEQ ID NO: 246403 - protein, 15 aa, Artificial Sequence
  Description of Artificial Sequence: Synthetic peptide
  Seed: VRVNARVRIAYPSLR (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXR

SEQ ID NO: 246404 - protein, 15 aa, Artificial Sequence
  Description of Artificial Sequence: Synthetic peptide
  Seed: VRVNARVRIAYPSLR (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLX

SEQ ID NO: 246405 - protein, 16 aa, Artificial Sequence
  Description of Artificial Sequence: Synthetic peptide
  Seed: VRVNARVRIAYPSLRE (MAGA4_HUMAN)
  Core: RVNARVRIA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVNXRXRIXYPSLRE

SEQ ID NO: 246406 - protein, 16 aa, Artificial Sequence
  Description of Artificial Sequence: Synthetic peptide
  Seed: VRVNARVRIAYPSLRE (MAGA4_HUMAN)
  Core: VNARVRIAY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXNAXVXIAXPSLRE

SEQ ID NO: 246407 - protein, 16 aa, Artificial Sequence
  Description of Artificial Sequence: Synthetic peptide
  Seed: VRVNARVRIAYPSLRE (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSLRE

SEQ ID NO: 246408 - protein, 16 aa, Artificial Sequence
  Description of Artificial Sequence: Synthetic peptide
  Seed: VRVNARVRIAYPSLRE (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLRE

SEQ ID NO: 246409 - protein, 16 aa, Artificial Sequence
  Description of Artificial Sequence: Synthetic peptide
  Seed: VRVNARVRIAYPSLRE (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXRE

SEQ ID NO: 246410 - protein, 16 aa, Artificial Sequence
  Description of Artificial Sequence: Synthetic peptide
  Seed: VRVNARVRIAYPSLRE (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXE

SEQ ID NO: 246411 - protein, 16 aa, Artificial Sequence
  Description of Artificial Sequence: Synthetic peptide
  Seed: VRVNARVRIAYPSLRE (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRX

SEQ ID NO: 246412 - protein, 17 aa, Artificial Sequence
  Description of Artificial Sequence: Synthetic peptide
  Seed: VRVNARVRIAYPSLREA (MAGA4_HUMAN)
  Core: VNARVRIAY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VRXNAXVXIAXPSLREA

SEQ ID NO: 246413 - protein, 17 aa, Artificial Sequence
  Description of Artificial Sequence: Synthetic peptide
  Seed: VRVNARVRIAYPSLREA (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSLREA

SEQ ID NO: 246414 - protein, 17 aa, Artificial Sequence
  Description of Artificial Sequence: Synthetic peptide
  Seed: VRVNARVRIAYPSLREA (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREA

SEQ ID NO: 246415 - protein, 17 aa, Artificial Sequence
  Description of Artificial Sequence: Synthetic peptide
  Seed: VRVNARVRIAYPSLREA (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREA

SEQ ID NO: 246416 - protein, 17 aa, Artificial Sequence
  Description of Artificial Sequence: Synthetic peptide
  Seed: VRVNARVRIAYPSLREA (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEA

SEQ ID NO: 246417 - protein, 17 aa, Artificial Sequence
  Description of Artificial Sequence: Synthetic peptide
  Seed: VRVNARVRIAYPSLREA (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXA

SEQ ID NO: 246418 - protein, 17 aa, Artificial Sequence
  Description of Artificial Sequence: Synthetic peptide
  Seed: VRVNARVRIAYPSLREA (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREX

SEQ ID NO: 246419 - protein, 18 aa, Artificial Sequence
  Description of Artificial Sequence: Synthetic peptide
  Seed: VRVNARVRIAYPSLREAA (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSLREAA

SEQ ID NO: 246420 - protein, 18 aa, Artificial Sequence
  Description of Artificial Sequence: Synthetic peptide
  Seed: VRVNARVRIAYPSLREAA (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAA

SEQ ID NO: 246421 - protein, 18 aa, Artificial Sequence
  Description of Artificial Sequence: Synthetic peptide
  Seed: VRVNARVRIAYPSLREAA (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAA

SEQ ID NO: 246422 - protein, 18 aa, Artificial Sequence
  Description of Artificial Sequence: Synthetic peptide
  Seed: VRVNARVRIAYPSLREAA (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAA

SEQ ID NO: 246423 - protein, 18 aa, Artificial Sequence
  Description of Artificial Sequence: Synthetic peptide
  Seed: VRVNARVRIAYPSLREAA (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXA

SEQ ID NO: 246424 - protein, 19 aa, Artificial Sequence
  Description of Artificial Sequence: Synthetic peptide
  Seed: VRVNARVRIAYPSLREAAL (MAGA4_HUMAN)
  Core: NARVRIAYP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VRVXARXRXAYXSLREAAL

SEQ ID NO: 246425 - protein, 19 aa, Artificial Sequence
  Description of Artificial Sequence: Synthetic peptide
  Seed: VRVNARVRIAYPSLREAAL (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAAL

SEQ ID NO: 246426 - protein, 19 aa, Artificial Sequence
  Description of Artificial Sequence: Synthetic peptide
  Seed: VRVNARVRIAYPSLREAAL (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAAL

SEQ ID NO: 246427 - protein, 19 aa, Artificial Sequence
  Description of Artificial Sequence: Synthetic peptide
  Seed: VRVNARVRIAYPSLREAAL (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAAL

SEQ ID NO: 246428 - protein, 19 aa, Artificial Sequence
  Description of Artificial Sequence: Synthetic peptide
  Seed: VRVNARVRIAYPSLREAAL (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAAL

SEQ ID NO: 246429 - protein, 19 aa, Artificial Sequence
  Description of Artificial Sequence: Synthetic peptide
  Seed: VRVNARVRIAYPSLREAAL (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXAL

SEQ ID NO: 246430 - protein, 21 aa, Artificial Sequence
  Description of Artificial Sequence: Synthetic peptide
  Seed: VRVNARVRIAYPSLREAALLE (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAALLE

SEQ ID NO: 246431 - protein, 21 aa, Artificial Sequence
  Description of Artificial Sequence: Synthetic peptide
  Seed: VRVNARVRIAYPSLREAALLE (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAALLE

SEQ ID NO: 246432 - protein, 21 aa, Artificial Sequence
  Description of Artificial Sequence: Synthetic peptide
  Seed: VRVNARVRIAYPSLREAALLE (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAALLE

SEQ ID NO: 246433 - protein, 21 aa, Artificial Sequence
  Description of Artificial Sequence: Synthetic peptide
  Seed: VRVNARVRIAYPSLREAALLE (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAALLE

SEQ ID NO: 246434 - protein, 21 aa, Artificial Sequence
  Description of Artificial Sequence: Synthetic peptide
  Seed: VRVNARVRIAYPSLREAALLE (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXALLE

SEQ ID NO: 246435 - protein, 22 aa, Artificial Sequence
  Description of Artificial Sequence: Synthetic peptide
  Seed: VRVNARVRIAYPSLREAALLEE (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAALLEE

SEQ ID NO: 246436 - protein, 22 aa, Artificial Sequence
  Description of Artificial Sequence: Synthetic peptide
  Seed: VRVNARVRIAYPSLREAALLEE (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAALLEE

SEQ ID NO: 246437 - protein, 22 aa, Artificial Sequence
  Description of Artificial Sequence: Synthetic peptide
  Seed: VRVNARVRIAYPSLREAALLEE (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAALLEE

SEQ ID NO: 246438 - protein, 22 aa, Artificial Sequence
  Description of Artificial Sequence: Synthetic peptide
  Seed: VRVNARVRIAYPSLREAALLEE (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAALLEE

SEQ ID NO: 246439 - protein, 22 aa, Artificial Sequence
  Description of Artificial Sequence: Synthetic peptide
  Seed: VRVNARVRIAYPSLREAALLEE (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXALLEE

SEQ ID NO: 246440 - protein, 23 aa, Artificial Sequence
  Description of Artificial Sequence: Synthetic peptide
  Seed: VRVNARVRIAYPSLREAALLEEE (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAALLEEE

SEQ ID NO: 246441 - protein, 23 aa, Artificial Sequence
  Description of Artificial Sequence: Synthetic peptide
  Seed: VRVNARVRIAYPSLREAALLEEE (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAALLEEE

SEQ ID NO: 246442 - protein, 23 aa, Artificial Sequence
  Description of Artificial Sequence: Synthetic peptide
  Seed: VRVNARVRIAYPSLREAALLEEE (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAALLEEE

SEQ ID NO: 246443 - protein, 23 aa, Artificial Sequence
  Description of Artificial Sequence: Synthetic peptide
  Seed: VRVNARVRIAYPSLREAALLEEE (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAALLEEE

SEQ ID NO: 246444 - protein, 23 aa, Artificial Sequence
  Description of Artificial Sequence: Synthetic peptide
  Seed: VRVNARVRIAYPSLREAALLEEE (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXALLEEE

SEQ ID NO: 246445 - protein, 23 aa, Artificial Sequence
  Description of Artificial Sequence: Synthetic peptide
  Seed: VRVNARVRIAYPSLREAALLEEE (MAGA4_HUMAN)
  Core: LREAALLEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSXREXAXLEXE

SEQ ID NO: 246446 - protein, 23 aa, Artificial Sequence
  Description of Artificial Sequence: Synthetic peptide
  Seed: VRVNARVRIAYPSLREAALLEEE (MAGA4_HUMAN)
  Core: REAALLEEE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSLXEAXLXEEX

SEQ ID NO: 246447 - protein, 24 aa, Artificial Sequence
  Description of Artificial Sequence: Synthetic peptide
  Seed: VRVNARVRIAYPSLREAALLEEEE (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAALLEEEE

SEQ ID NO: 246448 - protein, 24 aa, Artificial Sequence
  Description of Artificial Sequence: Synthetic peptide
  Seed: VRVNARVRIAYPSLREAALLEEEE (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAALLEEEE

SEQ ID NO: 246449 - protein, 24 aa, Artificial Sequence
  Description of Artificial Sequence: Synthetic peptide
  Seed: VRVNARVRIAYPSLREAALLEEEE (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAALLEEEE

SEQ ID NO: 246450 - protein, 24 aa, Artificial Sequence
  Description of Artificial Sequence: Synthetic peptide
  Seed: VRVNARVRIAYPSLREAALLEEEE (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAALLEEEE

SEQ ID NO: 246451 - protein, 24 aa, Artificial Sequence
  Description of Artificial Sequence: Synthetic peptide
  Seed: VRVNARVRIAYPSLREAALLEEEE (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXALLEEEE

SEQ ID NO: 246452 - protein, 24 aa, Artificial Sequence
  Description of Artificial Sequence: Synthetic peptide
  Seed: VRVNARVRIAYPSLREAALLEEEE (MAGA4_HUMAN)
  Core: LREAALLEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSXREXAXLEXEE

SEQ ID NO: 246453 - protein, 24 aa, Artificial Sequence
  Description of Artificial Sequence: Synthetic peptide
  Seed: VRVNARVRIAYPSLREAALLEEEE (MAGA4_HUMAN)
  Core: REAALLEEE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSLXEAXLXEEXE

SEQ ID NO: 246454 - protein, 25 aa, Artificial Sequence
  Description of Artificial Sequence: Synthetic peptide
  Seed: VRVNARVRIAYPSLREAALLEEEEG (MAGA4_HUMAN)
  Core: ARVRIAYPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VRVNXRVXIXYPXLREAALLEEEEG

SEQ ID NO: 246455 - protein, 25 aa, Artificial Sequence
  Description of Artificial Sequence: Synthetic peptide
  Seed: VRVNARVRIAYPSLREAALLEEEEG (MAGA4_HUMAN)
  Core: RVRIAYPSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VRVNAXVRXAXPSXREAALLEEEEG

SEQ ID NO: 246456 - protein, 25 aa, Artificial Sequence
  Description of Artificial Sequence: Synthetic peptide
  Seed: VRVNARVRIAYPSLREAALLEEEEG (MAGA4_HUMAN)
  Core: VRIAYPSLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARXRIXYXSLXEAALLEEEEG

SEQ ID NO: 246457 - protein, 25 aa, Artificial Sequence
  Description of Artificial Sequence: Synthetic peptide
  Seed: VRVNARVRIAYPSLREAALLEEEEG (MAGA4_HUMAN)
  Core: RIAYPSLRE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVXIAXPXLRXAALLEEEEG

SEQ ID NO: 246458 - protein, 25 aa, Artificial Sequence
  Description of Artificial Sequence: Synthetic peptide
  Seed: VRVNARVRIAYPSLREAALLEEEEG (MAGA4_HUMAN)
  Core: IAYPSLREA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRXAYXSXREXALLEEEEG

SEQ ID NO: 246459 - protein, 25 aa, Artificial Sequence
  Description of Artificial Sequence: Synthetic peptide
  Seed: VRVNARVRIAYPSLREAALLEEEEG (MAGA4_HUMAN)
  Core: LREAALLEE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSXREXAXLEXEEG

SEQ ID NO: 246460 - protein, 25 aa, Artificial Sequence
  Description of Artificial Sequence: Synthetic peptide
  Seed: VRVNARVRIAYPSLREAALLEEEEG (MAGA4_HUMAN)
  Core: REAALLEEE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VRVNARVRIAYPSLXEAXLXEEXEG

SEQ ID NO: 246461 - protein, 14 aa, Artificial Sequence
  Description of Artificial Sequence: Synthetic peptide
  Seed: VSSSSPLVPGTLEE (MAGA4_HUMAN)
  Core: SSSPLVPGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSSXLXPGXLEE

SEQ ID NO: 246462 - protein, 15 aa, Artificial Sequence
  Description of Artificial Sequence: Synthetic peptide
  Seed: VSSSSPLVPGTLEEV (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEX

SEQ ID NO: 246463 - protein, 16 aa, Artificial Sequence
  Description of Artificial Sequence: Synthetic peptide
  Seed: VSSSSPLVPGTLEEVP (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXP

SEQ ID NO: 246464 - protein, 17 aa, Artificial Sequence
  Description of Artificial Sequence: Synthetic peptide
  Seed: VSSSSPLVPGTLEEVPA (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXPA

SEQ ID NO: 246465 - protein, 19 aa, Artificial Sequence
  Description of Artificial Sequence: Synthetic peptide
  Seed: VSSSSPLVPGTLEEVPAAE (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXPAAE

SEQ ID NO: 246466 - protein, 19 aa, Artificial Sequence
  Description of Artificial Sequence: Synthetic peptide
  Seed: VSSSSPLVPGTLEEVPAAE (MAGA4_HUMAN)
  Core: PGTLEEVPA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVXGTXEXVPXAE

SEQ ID NO: 246467 - protein, 20 aa, Artificial Sequence
  Description of Artificial Sequence: Synthetic peptide
  Seed: VSSSSPLVPGTLEEVPAAES (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXPAAES

SEQ ID NO: 246468 - protein, 20 aa, Artificial Sequence
  Description of Artificial Sequence: Synthetic peptide
  Seed: VSSSSPLVPGTLEEVPAAES (MAGA4_HUMAN)
  Core: PGTLEEVPA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVXGTXEXVPXAES

SEQ ID NO: 246469 - protein, 21 aa, Artificial Sequence
  Description of Artificial Sequence: Synthetic peptide
  Seed: VSSSSPLVPGTLEEVPAAESA (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXPAAESA

SEQ ID NO: 246470 - protein, 22 aa, Artificial Sequence
  Description of Artificial Sequence: Synthetic peptide
  Seed: VSSSSPLVPGTLEEVPAAESAG (MAGA4_HUMAN)
  Core: LVPGTLEEV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPXVPXTXEEXPAAESAG

SEQ ID NO: 246471 - protein, 23 aa, Artificial Sequence
  Description of Artificial Sequence: Synthetic peptide
  Seed: VSSSSPLVPGTLEEVPAAESAGP (MAGA4_HUMAN)
  Core: LEEVPAAES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVPGTXEEXPXAEXAGP

SEQ ID NO: 246472 - protein, 24 aa, Artificial Sequence
  Description of Artificial Sequence: Synthetic peptide
  Seed: VSSSSPLVPGTLEEVPAAESAGPP (MAGA4_HUMAN)
  Core: PGTLEEVPA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVXGTXEXVPXAESAGPP

SEQ ID NO: 246473 - protein, 24 aa, Artificial Sequence
  Description of Artificial Sequence: Synthetic peptide
  Seed: VSSSSPLVPGTLEEVPAAESAGPP (MAGA4_HUMAN)
  Core: LEEVPAAES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVPGTXEEXPXAEXAGPP

SEQ ID NO: 246474 - protein, 25 aa, Artificial Sequence
  Description of Artificial Sequence: Synthetic peptide
  Seed: VSSSSPLVPGTLEEVPAAESAGPPQ (MAGA4_HUMAN)
  Core: PGTLEEVPA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVXGTXEXVPXAESAGPPQ

SEQ ID NO: 246475 - protein, 25 aa, Artificial Sequence
  Description of Artificial Sequence: Synthetic peptide
  Seed: VSSSSPLVPGTLEEVPAAESAGPPQ (MAGA4_HUMAN)
  Core: LEEVPAAES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSSSSPLVPGTXEEXPXAEXAGPPQ

SEQ ID NO: 246476 - protein, 14 aa, Artificial Sequence
  Description of Artificial Sequence: Synthetic peptide
  Seed: VTCLGLSYDGLLGN (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGN

SEQ ID NO: 246477 - protein, 14 aa, Artificial Sequence
  Description of Artificial Sequence: Synthetic peptide
  Seed: VTCLGLSYDGLLGN (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGX

SEQ ID NO: 246478 - protein, 15 aa, Artificial Sequence
  Description of Artificial Sequence: Synthetic peptide
  Seed: VTCLGLSYDGLLGNN (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGNN

SEQ ID NO: 246479 - protein, 16 aa, Artificial Sequence
  Description of Artificial Sequence: Synthetic peptide
  Seed: VTCLGLSYDGLLGNNQ (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGNNQ

SEQ ID NO: 246480 - protein, 17 aa, Artificial Sequence
  Description of Artificial Sequence: Synthetic peptide
  Seed: VTCLGLSYDGLLGNNQI (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGNNQI

SEQ ID NO: 246481 - protein, 17 aa, Artificial Sequence
  Description of Artificial Sequence: Synthetic peptide
  Seed: VTCLGLSYDGLLGNNQI (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXI

SEQ ID NO: 246482 - protein, 18 aa, Artificial Sequence
  Description of Artificial Sequence: Synthetic peptide
  Seed: VTCLGLSYDGLLGNNQIF (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIF

SEQ ID NO: 246483 - protein, 19 aa, Artificial Sequence
  Description of Artificial Sequence: Synthetic peptide
  Seed: VTCLGLSYDGLLGNNQIFP (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGNNQIFP

SEQ ID NO: 246484 - protein, 19 aa, Artificial Sequence
  Description of Artificial Sequence: Synthetic peptide
  Seed: VTCLGLSYDGLLGNNQIFP (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFP

SEQ ID NO: 246485 - protein, 19 aa, Artificial Sequence
  Description of Artificial Sequence: Synthetic peptide
  Seed: VTCLGLSYDGLLGNNQIFP (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFP

SEQ ID NO: 246486 - protein, 20 aa, Artificial Sequence
  Description of Artificial Sequence: Synthetic peptide
  Seed: VTCLGLSYDGLLGNNQIFPK (MAGA4_HUMAN)
  Core: LGLSYDGLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTCXGLXYXGLXGNNQIFPK

SEQ ID NO: 246487 - protein, 20 aa, Artificial Sequence
  Description of Artificial Sequence: Synthetic peptide
  Seed: VTCLGLSYDGLLGNNQIFPK (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPK

SEQ ID NO: 246488 - protein, 20 aa, Artificial Sequence
  Description of Artificial Sequence: Synthetic peptide
  Seed: VTCLGLSYDGLLGNNQIFPK (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPK

SEQ ID NO: 246489 - protein, 20 aa, Artificial Sequence
  Description of Artificial Sequence: Synthetic peptide
  Seed: VTCLGLSYDGLLGNNQIFPK (MAGA4_HUMAN)
  Core: DGLLGNNQI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSYXGLXGXNQXFPK

SEQ ID NO: 246490 - protein, 21 aa, Artificial Sequence
  Description of Artificial Sequence: Synthetic peptide
  Seed: VTCLGLSYDGLLGNNQIFPKT (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPKT

SEQ ID NO: 246491 - protein, 21 aa, Artificial Sequence
  Description of Artificial Sequence: Synthetic peptide
  Seed: VTCLGLSYDGLLGNNQIFPKT (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPKT

SEQ ID NO: 246492 - protein, 22 aa, Artificial Sequence
  Description of Artificial Sequence: Synthetic peptide
  Seed: VTCLGLSYDGLLGNNQIFPKTG (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPKTG

SEQ ID NO: 246493 - protein, 22 aa, Artificial Sequence
  Description of Artificial Sequence: Synthetic peptide
  Seed: VTCLGLSYDGLLGNNQIFPKTG (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPKTG

SEQ ID NO: 246494 - protein, 23 aa, Artificial Sequence
  Description of Artificial Sequence: Synthetic peptide
  Seed: VTCLGLSYDGLLGNNQIFPKTGL (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPKTGL

SEQ ID NO: 246495 - protein, 23 aa, Artificial Sequence
  Description of Artificial Sequence: Synthetic peptide
  Seed: VTCLGLSYDGLLGNNQIFPKTGL (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPKTGL

SEQ ID NO: 246496 - protein, 24 aa, Artificial Sequence
  Description of Artificial Sequence: Synthetic peptide
  Seed: VTCLGLSYDGLLGNNQIFPKTGLL (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPKTGLL

SEQ ID NO: 246497 - protein, 24 aa, Artificial Sequence
  Description of Artificial Sequence: Synthetic peptide
  Seed: VTCLGLSYDGLLGNNQIFPKTGLL (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPKTGLL

SEQ ID NO: 246498 - protein, 25 aa, Artificial Sequence
  Description of Artificial Sequence: Synthetic peptide
  Seed: VTCLGLSYDGLLGNNQIFPKTGLLI (MAGA4_HUMAN)
  Core: LSYDGLLGN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGXSYXGXLGXNQIFPKTGLLI

SEQ ID NO: 246499 - protein, 25 aa, Artificial Sequence
  Description of Artificial Sequence: Synthetic peptide
  Seed: VTCLGLSYDGLLGNNQIFPKTGLLI (MAGA4_HUMAN)
  Core: YDGLLGNNQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSXDGXLXNNXIFPKTGLLI

SEQ ID NO: 246500 - protein, 25 aa, Artificial Sequence
  Description of Artificial Sequence: Synthetic peptide
  Seed: VTCLGLSYDGLLGNNQIFPKTGLLI (MAGA4_HUMAN)
  Core: LLGNNQIFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSYDGXLGXNXIFXKTGLLI

SEQ ID NO: 246501 - protein, 25 aa, Artificial Sequence
  Description of Artificial Sequence: Synthetic peptide
  Seed: VTCLGLSYDGLLGNNQIFPKTGLLI (MAGA4_HUMAN)
  Core: LGNNQIFPK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSYDGLXGNXQXFPXTGLLI

SEQ ID NO: 246502 - protein, 25 aa, Artificial Sequence
  Description of Artificial Sequence: Synthetic peptide
  Seed: VTCLGLSYDGLLGNNQIFPKTGLLI (MAGA4_HUMAN)
  Core: IFPKTGLLI
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
VTCLGLSYDGLLGNNQXFPXTXLLX

SEQ ID NO: 246503 - protein, 14 aa, Artificial Sequence
  Description of Artificial Sequence: Synthetic peptide
  Seed: VTKAEMLERVIKNY (MAGA4_HUMAN)
  Core: TKAEMLERV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKAXMXERXIKNY

SEQ ID NO: 246504 - protein, 14 aa, Artificial Sequence
  Description of Artificial Sequence: Synthetic peptide
  Seed: VTKAEMLERVIKNY (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXY

SEQ ID NO: 246505 - protein, 15 aa, Artificial Sequence
  Description of Artificial Sequence: Synthetic peptide
  Seed: VTKAEMLERVIKNYK (MAGA4_HUMAN)
  Core: TKAEMLERV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKAXMXERXIKNYK

SEQ ID NO: 246506 - protein, 15 aa, Artificial Sequence
  Description of Artificial Sequence: Synthetic peptide
  Seed: VTKAEMLERVIKNYK (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYK

SEQ ID NO: 246507 - protein, 15 aa, Artificial Sequence
  Description of Artificial Sequence: Synthetic peptide
  Seed: VTKAEMLERVIKNYK (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYX

SEQ ID NO: 246508 - protein, 16 aa, Artificial Sequence
  Description of Artificial Sequence: Synthetic peptide
  Seed: VTKAEMLERVIKNYKR (MAGA4_HUMAN)
  Core: TKAEMLERV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKAXMXERXIKNYKR

SEQ ID NO: 246509 - protein, 16 aa, Artificial Sequence
  Description of Artificial Sequence: Synthetic peptide
  Seed: VTKAEMLERVIKNYKR (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKR

SEQ ID NO: 246510 - protein, 16 aa, Artificial Sequence
  Description of Artificial Sequence: Synthetic peptide
  Seed: VTKAEMLERVIKNYKR (MAGA4_HUMAN)
  Core: MLERVIKNY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEXLEXVXKNXKR

SEQ ID NO: 246511 - protein, 16 aa, Artificial Sequence
  Description of Artificial Sequence: Synthetic peptide
  Seed: VTKAEMLERVIKNYKR (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXR

SEQ ID NO: 246512 - protein, 17 aa, Artificial Sequence
  Description of Artificial Sequence: Synthetic peptide
  Seed: VTKAEMLERVIKNYKRC (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRC

SEQ ID NO: 246513 - protein, 17 aa, Artificial Sequence
  Description of Artificial Sequence: Synthetic peptide
  Seed: VTKAEMLERVIKNYKRC (MAGA4_HUMAN)
  Core: MLERVIKNY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEXLEXVXKNXKRC

SEQ ID NO: 246514 - protein, 17 aa, Artificial Sequence
  Description of Artificial Sequence: Synthetic peptide
  Seed: VTKAEMLERVIKNYKRC (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRC

SEQ ID NO: 246515 - protein, 18 aa, Artificial Sequence
  Description of Artificial Sequence: Synthetic peptide
  Seed: VTKAEMLERVIKNYKRCF (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCF

SEQ ID NO: 246516 - protein, 18 aa, Artificial Sequence
  Description of Artificial Sequence: Synthetic peptide
  Seed: VTKAEMLERVIKNYKRCF (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCF

SEQ ID NO: 246517 - protein, 19 aa, Artificial Sequence
  Description of Artificial Sequence: Synthetic peptide
  Seed: VTKAEMLERVIKNYKRCFP (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFP

SEQ ID NO: 246518 - protein, 19 aa, Artificial Sequence
  Description of Artificial Sequence: Synthetic peptide
  Seed: VTKAEMLERVIKNYKRCFP (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFP

SEQ ID NO: 246519 - protein, 19 aa, Artificial Sequence
  Description of Artificial Sequence: Synthetic peptide
  Seed: VTKAEMLERVIKNYKRCFP (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFP

SEQ ID NO: 246520 - protein, 20 aa, Artificial Sequence
  Description of Artificial Sequence: Synthetic peptide
  Seed: VTKAEMLERVIKNYKRCFPV (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPV

SEQ ID NO: 246521 - protein, 20 aa, Artificial Sequence
  Description of Artificial Sequence: Synthetic peptide
  Seed: VTKAEMLERVIKNYKRCFPV (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPV

SEQ ID NO: 246522 - protein, 20 aa, Artificial Sequence
  Description of Artificial Sequence: Synthetic peptide
  Seed: VTKAEMLERVIKNYKRCFPV (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPV

SEQ ID NO: 246523 - protein, 20 aa, Artificial Sequence
  Description of Artificial Sequence: Synthetic peptide
  Seed: VTKAEMLERVIKNYKRCFPV (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPV

SEQ ID NO: 246524 - protein, 20 aa, Artificial Sequence
  Description of Artificial Sequence: Synthetic peptide
  Seed: VTKAEMLERVIKNYKRCFPV (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPV

SEQ ID NO: 246525 - protein, 20 aa, Artificial Sequence
  Description of Artificial Sequence: Synthetic peptide
  Seed: VTKAEMLERVIKNYKRCFPV (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXV

SEQ ID NO: 246526 - protein, 21 aa, Artificial Sequence
  Description of Artificial Sequence: Synthetic peptide
  Seed: VTKAEMLERVIKNYKRCFPVI (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPVI

SEQ ID NO: 246527 - protein, 21 aa, Artificial Sequence
  Description of Artificial Sequence: Synthetic peptide
  Seed: VTKAEMLERVIKNYKRCFPVI (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPVI

SEQ ID NO: 246528 - protein, 21 aa, Artificial Sequence
  Description of Artificial Sequence: Synthetic peptide
  Seed: VTKAEMLERVIKNYKRCFPVI (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPVI

SEQ ID NO: 246529 - protein, 21 aa, Artificial Sequence
  Description of Artificial Sequence: Synthetic peptide
  Seed: VTKAEMLERVIKNYKRCFPVI (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPVI

SEQ ID NO: 246530 - protein, 21 aa, Artificial Sequence
  Description of Artificial Sequence: Synthetic peptide
  Seed: VTKAEMLERVIKNYKRCFPVI (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPVI

SEQ ID NO: 246531 - protein, 21 aa, Artificial Sequence
  Description of Artificial Sequence: Synthetic peptide
  Seed: VTKAEMLERVIKNYKRCFPVI (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXVI

SEQ ID NO: 246532 - protein, 21 aa, Artificial Sequence
  Description of Artificial Sequence: Synthetic peptide
  Seed: VTKAEMLERVIKNYKRCFPVI (MAGA4_HUMAN)
  Core: KNYKRCFPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIXNYXRXFPXI

SEQ ID NO: 246533 - protein, 22 aa, Artificial Sequence
  Description of Artificial Sequence: Synthetic peptide
  Seed: VTKAEMLERVIKNYKRCFPVIF (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPVIF

SEQ ID NO: 246534 - protein, 22 aa, Artificial Sequence
  Description of Artificial Sequence: Synthetic peptide
  Seed: VTKAEMLERVIKNYKRCFPVIF (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPVIF

SEQ ID NO: 246535 - protein, 22 aa, Artificial Sequence
  Description of Artificial Sequence: Synthetic peptide
  Seed: VTKAEMLERVIKNYKRCFPVIF (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPVIF

SEQ ID NO: 246536 - protein, 22 aa, Artificial Sequence
  Description of Artificial Sequence: Synthetic peptide
  Seed: VTKAEMLERVIKNYKRCFPVIF (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPVIF

SEQ ID NO: 246537 - protein, 22 aa, Artificial Sequence
  Description of Artificial Sequence: Synthetic peptide
  Seed: VTKAEMLERVIKNYKRCFPVIF (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPVIF

SEQ ID NO: 246538 - protein, 22 aa, Artificial Sequence
  Description of Artificial Sequence: Synthetic peptide
  Seed: VTKAEMLERVIKNYKRCFPVIF (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXVIF

SEQ ID NO: 246539 - protein, 22 aa, Artificial Sequence
  Description of Artificial Sequence: Synthetic peptide
  Seed: VTKAEMLERVIKNYKRCFPVIF (MAGA4_HUMAN)
  Core: KNYKRCFPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIXNYXRXFPXIF

SEQ ID NO: 246540 - protein, 22 aa, Artificial Sequence
  Description of Artificial Sequence: Synthetic peptide
  Seed: VTKAEMLERVIKNYKRCFPVIF (MAGA4_HUMAN)
  Core: YKRCFPVIF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIKNXKRXFXVIX

SEQ ID NO: 246541 - protein, 23 aa, Artificial Sequence
  Description of Artificial Sequence: Synthetic peptide
  Seed: VTKAEMLERVIKNYKRCFPVIFG (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPVIFG

SEQ ID NO: 246542 - protein, 23 aa, Artificial Sequence
  Description of Artificial Sequence: Synthetic peptide
  Seed: VTKAEMLERVIKNYKRCFPVIFG (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPVIFG

SEQ ID NO: 246543 - protein, 23 aa, Artificial Sequence
  Description of Artificial Sequence: Synthetic peptide
  Seed: VTKAEMLERVIKNYKRCFPVIFG (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPVIFG

SEQ ID NO: 246544 - protein, 23 aa, Artificial Sequence
  Description of Artificial Sequence: Synthetic peptide
  Seed: VTKAEMLERVIKNYKRCFPVIFG (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPVIFG

SEQ ID NO: 246545 - protein, 23 aa, Artificial Sequence
  Description of Artificial Sequence: Synthetic peptide
  Seed: VTKAEMLERVIKNYKRCFPVIFG (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPVIFG

SEQ ID NO: 246546 - protein, 23 aa, Artificial Sequence
  Description of Artificial Sequence: Synthetic peptide
  Seed: VTKAEMLERVIKNYKRCFPVIFG (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXVIFG

SEQ ID NO: 246547 - protein, 23 aa, Artificial Sequence
  Description of Artificial Sequence: Synthetic peptide
  Seed: VTKAEMLERVIKNYKRCFPVIFG (MAGA4_HUMAN)
  Core: KNYKRCFPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIXNYXRXFPXIFG

SEQ ID NO: 246548 - protein, 23 aa, Artificial Sequence
  Description of Artificial Sequence: Synthetic peptide
  Seed: VTKAEMLERVIKNYKRCFPVIFG (MAGA4_HUMAN)
  Core: YKRCFPVIF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIKNXKRXFXVIXG

SEQ ID NO: 246549 - protein, 24 aa, Artificial Sequence
  Description of Artificial Sequence: Synthetic peptide
  Seed: VTKAEMLERVIKNYKRCFPVIFGK (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPVIFGK

SEQ ID NO: 246550 - protein, 24 aa, Artificial Sequence
  Description of Artificial Sequence: Synthetic peptide
  Seed: VTKAEMLERVIKNYKRCFPVIFGK (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPVIFGK

SEQ ID NO: 246551 - protein, 24 aa, Artificial Sequence
  Description of Artificial Sequence: Synthetic peptide
  Seed: VTKAEMLERVIKNYKRCFPVIFGK (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPVIFGK

SEQ ID NO: 246552 - protein, 24 aa, Artificial Sequence
  Description of Artificial Sequence: Synthetic peptide
  Seed: VTKAEMLERVIKNYKRCFPVIFGK (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPVIFGK

SEQ ID NO: 246553 - protein, 24 aa, Artificial Sequence
  Description of Artificial Sequence: Synthetic peptide
  Seed: VTKAEMLERVIKNYKRCFPVIFGK (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPVIFGK

SEQ ID NO: 246554 - protein, 24 aa, Artificial Sequence
  Description of Artificial Sequence: Synthetic peptide
  Seed: VTKAEMLERVIKNYKRCFPVIFGK (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXVIFGK

SEQ ID NO: 246555 - protein, 24 aa, Artificial Sequence
  Description of Artificial Sequence: Synthetic peptide
  Seed: VTKAEMLERVIKNYKRCFPVIFGK (MAGA4_HUMAN)
  Core: KNYKRCFPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIXNYXRXFPXIFGK

SEQ ID NO: 246556 - protein, 24 aa, Artificial Sequence
  Description of Artificial Sequence: Synthetic peptide
  Seed: VTKAEMLERVIKNYKRCFPVIFGK (MAGA4_HUMAN)
  Core: YKRCFPVIF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIKNXKRXFXVIXGK

SEQ ID NO: 246557 - protein, 25 aa, Artificial Sequence
  Description of Artificial Sequence: Synthetic peptide
  Seed: VTKAEMLERVIKNYKRCFPVIFGKA (MAGA4_HUMAN)
  Core: EMLERVIKN
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTKAXMLXRXIKXYKRCFPVIFGKA

SEQ ID NO: 246558 - protein, 25 aa, Artificial Sequence
  Description of Artificial Sequence: Synthetic peptide
  Seed: VTKAEMLERVIKNYKRCFPVIFGKA (MAGA4_HUMAN)
  Core: LERVIKNYK
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMXERXIXNYXRCFPVIFGKA

SEQ ID NO: 246559 - protein, 25 aa, Artificial Sequence
  Description of Artificial Sequence: Synthetic peptide
  Seed: VTKAEMLERVIKNYKRCFPVIFGKA (MAGA4_HUMAN)
  Core: ERVIKNYKR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLXRVXKXYKXCFPVIFGKA

SEQ ID NO: 246560 - protein, 25 aa, Artificial Sequence
  Description of Artificial Sequence: Synthetic peptide
  Seed: VTKAEMLERVIKNYKRCFPVIFGKA (MAGA4_HUMAN)
  Core: RVIKNYKRC
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLEXVIXNXKRXFPVIFGKA

SEQ ID NO: 246561 - protein, 25 aa, Artificial Sequence
  Description of Artificial Sequence: Synthetic peptide
  Seed: VTKAEMLERVIKNYKRCFPVIFGKA (MAGA4_HUMAN)
  Core: VIKNYKRCF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERXIKXYXRCXPVIFGKA

SEQ ID NO: 246562 - protein, 25 aa, Artificial Sequence
  Description of Artificial Sequence: Synthetic peptide
  Seed: VTKAEMLERVIKNYKRCFPVIFGKA (MAGA4_HUMAN)
  Core: IKNYKRCFP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVXKNXKXCFXVIFGKA

SEQ ID NO: 246563 - protein, 25 aa, Artificial Sequence
  Description of Artificial Sequence: Synthetic peptide
  Seed: VTKAEMLERVIKNYKRCFPVIFGKA (MAGA4_HUMAN)
  Core: KNYKRCFPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIXNYXRXFPXIFGKA

SEQ ID NO: 246564 - protein, 25 aa, Artificial Sequence
  Description of Artificial Sequence: Synthetic peptide
  Seed: VTKAEMLERVIKNYKRCFPVIFGKA (MAGA4_HUMAN)
  Core: YKRCFPVIF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTKAEMLERVIKNXKRXFXVIXGKA

SEQ ID NO: 246565 - protein, 13 aa, Artificial Sequence
  Description of Artificial Sequence: Synthetic peptide
  Seed: VVRVNARVRIAYP (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYP

SEQ ID NO: 246566 - protein, 13 aa, Artificial Sequence
  Description of Artificial Sequence: Synthetic peptide
  Seed: VVRVNARVRIAYP (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXP

SEQ ID NO: 246567 - protein, 14 aa, Artificial Sequence
  Description of Artificial Sequence: Synthetic peptide
  Seed: VVRVNARVRIAYPS (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYPS

SEQ ID NO: 246568 - protein, 14 aa, Artificial Sequence
  Description of Artificial Sequence: Synthetic peptide
  Seed: VVRVNARVRIAYPS (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPS

SEQ ID NO: 246569 - protein, 14 aa, Artificial Sequence
  Description of Artificial Sequence: Synthetic peptide
  Seed: VVRVNARVRIAYPS (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPS

SEQ ID NO: 246570 - protein, 14 aa, Artificial Sequence
  Description of Artificial Sequence: Synthetic peptide
  Seed: VVRVNARVRIAYPS (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXS

SEQ ID NO: 246571 - protein, 14 aa, Artificial Sequence
  Description of Artificial Sequence: Synthetic peptide
  Seed: VVRVNARVRIAYPS (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPX

SEQ ID NO: 246572 - protein, 15 aa, Artificial Sequence
  Description of Artificial Sequence: Synthetic peptide
  Seed: VVRVNARVRIAYPSL (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYPSL

SEQ ID NO: 246573 - protein, 15 aa, Artificial Sequence
  Description of Artificial Sequence: Synthetic peptide
  Seed: VVRVNARVRIAYPSL (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPSL

SEQ ID NO: 246574 - protein, 15 aa, Artificial Sequence
  Description of Artificial Sequence: Synthetic peptide
  Seed: VVRVNARVRIAYPSL (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSL

SEQ ID NO: 246575 - protein, 15 aa, Artificial Sequence
  Description of Artificial Sequence: Synthetic peptide
  Seed: VVRVNARVRIAYPSL (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSL

SEQ ID NO: 246576 - protein, 15 aa, Artificial Sequence
  Description of Artificial Sequence: Synthetic peptide
  Seed: VVRVNARVRIAYPSL (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXL

SEQ ID NO: 246577 - protein, 16 aa, Artificial Sequence
  Description of Artificial Sequence: Synthetic peptide
  Seed: VVRVNARVRIAYPSLR (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYPSLR

SEQ ID NO: 246578 - protein, 16 aa, Artificial Sequence
  Description of Artificial Sequence: Synthetic peptide
  Seed: VVRVNARVRIAYPSLR (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPSLR

SEQ ID NO: 246579 - protein, 16 aa, Artificial Sequence
  Description of Artificial Sequence: Synthetic peptide
  Seed: VVRVNARVRIAYPSLR (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLR

SEQ ID NO: 246580 - protein, 16 aa, Artificial Sequence
  Description of Artificial Sequence: Synthetic peptide
  Seed: VVRVNARVRIAYPSLR (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLR

SEQ ID NO: 246581 - protein, 16 aa, Artificial Sequence
  Description of Artificial Sequence: Synthetic peptide
  Seed: VVRVNARVRIAYPSLR (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLR

SEQ ID NO: 246582 - protein, 16 aa, Artificial Sequence
  Description of Artificial Sequence: Synthetic peptide
  Seed: VVRVNARVRIAYPSLR (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXR

SEQ ID NO: 246583 - protein, 16 aa, Artificial Sequence
  Description of Artificial Sequence: Synthetic peptide
  Seed: VVRVNARVRIAYPSLR (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLX

SEQ ID NO: 246584 - protein, 17 aa, Artificial Sequence
  Description of Artificial Sequence: Synthetic peptide
  Seed: VVRVNARVRIAYPSLRE (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYPSLRE

SEQ ID NO: 246585 - protein, 17 aa, Artificial Sequence
  Description of Artificial Sequence: Synthetic peptide
  Seed: VVRVNARVRIAYPSLRE (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPSLRE

SEQ ID NO: 246586 - protein, 17 aa, Artificial Sequence
  Description of Artificial Sequence: Synthetic peptide
  Seed: VVRVNARVRIAYPSLRE (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLRE

SEQ ID NO: 246587 - protein, 17 aa, Artificial Sequence
  Description of Artificial Sequence: Synthetic peptide
  Seed: VVRVNARVRIAYPSLRE (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLRE

SEQ ID NO: 246588 - protein, 17 aa, Artificial Sequence
  Description of Artificial Sequence: Synthetic peptide
  Seed: VVRVNARVRIAYPSLRE (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLRE

SEQ ID NO: 246589 - protein, 17 aa, Artificial Sequence
  Description of Artificial Sequence: Synthetic peptide
  Seed: VVRVNARVRIAYPSLRE (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXRE

SEQ ID NO: 246590 - protein, 17 aa, Artificial Sequence
  Description of Artificial Sequence: Synthetic peptide
  Seed: VVRVNARVRIAYPSLRE (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXE

SEQ ID NO: 246591 - protein, 17 aa, Artificial Sequence
  Description of Artificial Sequence: Synthetic peptide
  Seed: VVRVNARVRIAYPSLRE (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRX

SEQ ID NO: 246592 - protein, 18 aa, Artificial Sequence
  Description of Artificial Sequence: Synthetic peptide
  Seed: VVRVNARVRIAYPSLREA (MAGA4_HUMAN)
  Core: VRVNARVRI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXRVXAXVRXAYPSLREA

SEQ ID NO: 246593 - protein, 18 aa, Artificial Sequence
  Description of Artificial Sequence: Synthetic peptide
  Seed: VVRVNARVRIAYPSLREA (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPSLREA

SEQ ID NO: 246594 - protein, 18 aa, Artificial Sequence
  Description of Artificial Sequence: Synthetic peptide
  Seed: VVRVNARVRIAYPSLREA (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREA

SEQ ID NO: 246595 - protein, 18 aa, Artificial Sequence
  Description of Artificial Sequence: Synthetic peptide
  Seed: VVRVNARVRIAYPSLREA (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREA

SEQ ID NO: 246596 - protein, 18 aa, Artificial Sequence
  Description of Artificial Sequence: Synthetic peptide
  Seed: VVRVNARVRIAYPSLREA (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREA

SEQ ID NO: 246597 - protein, 18 aa, Artificial Sequence
  Description of Artificial Sequence: Synthetic peptide
  Seed: VVRVNARVRIAYPSLREA (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEA

SEQ ID NO: 246598 - protein, 18 aa, Artificial Sequence
  Description of Artificial Sequence: Synthetic peptide
  Seed: VVRVNARVRIAYPSLREA (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXA

SEQ ID NO: 246599 - protein, 19 aa, Artificial Sequence
  Description of Artificial Sequence: Synthetic peptide
  Seed: VVRVNARVRIAYPSLREAA (MAGA4_HUMAN)
  Core: RVNARVRIA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXVNXRXRIXYPSLREAA

SEQ ID NO: 246600 - protein, 19 aa, Artificial Sequence
  Description of Artificial Sequence: Synthetic peptide
  Seed: VVRVNARVRIAYPSLREAA (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAA

SEQ ID NO: 246601 - protein, 19 aa, Artificial Sequence
  Description of Artificial Sequence: Synthetic peptide
  Seed: VVRVNARVRIAYPSLREAA (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAA

SEQ ID NO: 246602 - protein, 19 aa, Artificial Sequence
  Description of Artificial Sequence: Synthetic peptide
  Seed: VVRVNARVRIAYPSLREAA (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAA

SEQ ID NO: 246603 - protein, 19 aa, Artificial Sequence
  Description of Artificial Sequence: Synthetic peptide
  Seed: VVRVNARVRIAYPSLREAA (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAA

SEQ ID NO: 246604 - protein, 19 aa, Artificial Sequence
  Description of Artificial Sequence: Synthetic peptide
  Seed: VVRVNARVRIAYPSLREAA (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAA

SEQ ID NO: 246605 - protein, 19 aa, Artificial Sequence
  Description of Artificial Sequence: Synthetic peptide
  Seed: VVRVNARVRIAYPSLREAA (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAA

SEQ ID NO: 246606 - protein, 19 aa, Artificial Sequence
  Description of Artificial Sequence: Synthetic peptide
  Seed: VVRVNARVRIAYPSLREAA (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXA

SEQ ID NO: 246607 - protein, 20 aa, Artificial Sequence
  Description of Artificial Sequence: Synthetic peptide
  Seed: VVRVNARVRIAYPSLREAAL (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAAL

SEQ ID NO: 246608 - protein, 20 aa, Artificial Sequence
  Description of Artificial Sequence: Synthetic peptide
  Seed: VVRVNARVRIAYPSLREAAL (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAAL

SEQ ID NO: 246609 - protein, 20 aa, Artificial Sequence
  Description of Artificial Sequence: Synthetic peptide
  Seed: VVRVNARVRIAYPSLREAAL (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAAL

SEQ ID NO: 246610 - protein, 20 aa, Artificial Sequence
  Description of Artificial Sequence: Synthetic peptide
  Seed: VVRVNARVRIAYPSLREAAL (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAAL

SEQ ID NO: 246611 - protein, 20 aa, Artificial Sequence
  Description of Artificial Sequence: Synthetic peptide
  Seed: VVRVNARVRIAYPSLREAAL (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAAL

SEQ ID NO: 246612 - protein, 20 aa, Artificial Sequence
  Description of Artificial Sequence: Synthetic peptide
  Seed: VVRVNARVRIAYPSLREAAL (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAAL

SEQ ID NO: 246613 - protein, 20 aa, Artificial Sequence
  Description of Artificial Sequence: Synthetic peptide
  Seed: VVRVNARVRIAYPSLREAAL (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXAL

SEQ ID NO: 246614 - protein, 21 aa, Artificial Sequence
  Description of Artificial Sequence: Synthetic peptide
  Seed: VVRVNARVRIAYPSLREAALL (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAALL

SEQ ID NO: 246615 - protein, 21 aa, Artificial Sequence
  Description of Artificial Sequence: Synthetic peptide
  Seed: VVRVNARVRIAYPSLREAALL (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAALL

SEQ ID NO: 246616 - protein, 21 aa, Artificial Sequence
  Description of Artificial Sequence: Synthetic peptide
  Seed: VVRVNARVRIAYPSLREAALL (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAALL

SEQ ID NO: 246617 - protein, 21 aa, Artificial Sequence
  Description of Artificial Sequence: Synthetic peptide
  Seed: VVRVNARVRIAYPSLREAALL (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAALL

SEQ ID NO: 246618 - protein, 21 aa, Artificial Sequence
  Description of Artificial Sequence: Synthetic peptide
  Seed: VVRVNARVRIAYPSLREAALL (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAALL

SEQ ID NO: 246619 - protein, 21 aa, Artificial Sequence
  Description of Artificial Sequence: Synthetic peptide
  Seed: VVRVNARVRIAYPSLREAALL (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAALL

SEQ ID NO: 246620 - protein, 21 aa, Artificial Sequence
  Description of Artificial Sequence: Synthetic peptide
  Seed: VVRVNARVRIAYPSLREAALL (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXALL

SEQ ID NO: 246621 - protein, 22 aa, Artificial Sequence
  Description of Artificial Sequence: Synthetic peptide
  Seed: VVRVNARVRIAYPSLREAALLE (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAALLE

SEQ ID NO: 246622 - protein, 22 aa, Artificial Sequence
  Description of Artificial Sequence: Synthetic peptide
  Seed: VVRVNARVRIAYPSLREAALLE (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAALLE

SEQ ID NO: 246623 - protein, 22 aa, Artificial Sequence
  Description of Artificial Sequence: Synthetic peptide
  Seed: VVRVNARVRIAYPSLREAALLE (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAALLE

SEQ ID NO: 246624 - protein, 22 aa, Artificial Sequence
  Description of Artificial Sequence: Synthetic peptide
  Seed: VVRVNARVRIAYPSLREAALLE (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAALLE

SEQ ID NO: 246625 - protein, 22 aa, Artificial Sequence
  Description of Artificial Sequence: Synthetic peptide
  Seed: VVRVNARVRIAYPSLREAALLE (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAALLE

SEQ ID NO: 246626 - protein, 22 aa, Artificial Sequence
  Description of Artificial Sequence: Synthetic peptide
  Seed: VVRVNARVRIAYPSLREAALLE (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAALLE

SEQ ID NO: 246627 - protein, 22 aa, Artificial Sequence
  Description of Artificial Sequence: Synthetic peptide
  Seed: VVRVNARVRIAYPSLREAALLE (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXALLE

SEQ ID NO: 246628 - protein, 23 aa, Artificial Sequence
  Description of Artificial Sequence: Synthetic peptide
  Seed: VVRVNARVRIAYPSLREAALLEE (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAALLEE

SEQ ID NO: 246629 - protein, 23 aa, Artificial Sequence
  Description of Artificial Sequence: Synthetic peptide
  Seed: VVRVNARVRIAYPSLREAALLEE (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAALLEE

SEQ ID NO: 246630 - protein, 23 aa, Artificial Sequence
  Description of Artificial Sequence: Synthetic peptide
  Seed: VVRVNARVRIAYPSLREAALLEE (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAALLEE

SEQ ID NO: 246631 - protein, 23 aa, Artificial Sequence
  Description of Artificial Sequence: Synthetic peptide
  Seed: VVRVNARVRIAYPSLREAALLEE (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAALLEE

SEQ ID NO: 246632 - protein, 23 aa, Artificial Sequence
  Description of Artificial Sequence: Synthetic peptide
  Seed: VVRVNARVRIAYPSLREAALLEE (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAALLEE

SEQ ID NO: 246633 - protein, 23 aa, Artificial Sequence
  Description of Artificial Sequence: Synthetic peptide
  Seed: VVRVNARVRIAYPSLREAALLEE (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAALLEE

SEQ ID NO: 246634 - protein, 23 aa, Artificial Sequence
  Description of Artificial Sequence: Synthetic peptide
  Seed: VVRVNARVRIAYPSLREAALLEE (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXALLEE

SEQ ID NO: 246635 - protein, 24 aa, Artificial Sequence
  Description of Artificial Sequence: Synthetic peptide
  Seed: VVRVNARVRIAYPSLREAALLEEE (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAALLEEE

SEQ ID NO: 246636 - protein, 24 aa, Artificial Sequence
  Description of Artificial Sequence: Synthetic peptide
  Seed: VVRVNARVRIAYPSLREAALLEEE (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAALLEEE

SEQ ID NO: 246637 - protein, 24 aa, Artificial Sequence
  Description of Artificial Sequence: Synthetic peptide
  Seed: VVRVNARVRIAYPSLREAALLEEE (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAALLEEE

SEQ ID NO: 246638 - protein, 24 aa, Artificial Sequence
  Description of Artificial Sequence: Synthetic peptide
  Seed: VVRVNARVRIAYPSLREAALLEEE (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAALLEEE

SEQ ID NO: 246639 - protein, 24 aa, Artificial Sequence
  Description of Artificial Sequence: Synthetic peptide
  Seed: VVRVNARVRIAYPSLREAALLEEE (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAALLEEE

SEQ ID NO: 246640 - protein, 24 aa, Artificial Sequence
  Description of Artificial Sequence: Synthetic peptide
  Seed: VVRVNARVRIAYPSLREAALLEEE (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAALLEEE

SEQ ID NO: 246641 - protein, 24 aa, Artificial Sequence
  Description of Artificial Sequence: Synthetic peptide
  Seed: VVRVNARVRIAYPSLREAALLEEE (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXALLEEE

SEQ ID NO: 246642 - protein, 24 aa, Artificial Sequence
  Description of Artificial Sequence: Synthetic peptide
  Seed: VVRVNARVRIAYPSLREAALLEEE (MAGA4_HUMAN)
  Core: LREAALLEE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRIAYPSXREXAXLEXE

SEQ ID NO: 246643 - protein, 25 aa, Artificial Sequence
  Description of Artificial Sequence: Synthetic peptide
  Seed: VVRVNARVRIAYPSLREAALLEEEE (MAGA4_HUMAN)
  Core: VNARVRIAY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVRXNAXVXIAXPSLREAALLEEEE

SEQ ID NO: 246644 - protein, 25 aa, Artificial Sequence
  Description of Artificial Sequence: Synthetic peptide
  Seed: VVRVNARVRIAYPSLREAALLEEEE (MAGA4_HUMAN)
  Core: NARVRIAYP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVRVXARXRXAYXSLREAALLEEEE

SEQ ID NO: 246645 - protein, 25 aa, Artificial Sequence
  Description of Artificial Sequence: Synthetic peptide
  Seed: VVRVNARVRIAYPSLREAALLEEEE (MAGA4_HUMAN)
  Core: ARVRIAYPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNXRVXIXYPXLREAALLEEEE

SEQ ID NO: 246646 - protein, 25 aa, Artificial Sequence
  Description of Artificial Sequence: Synthetic peptide
  Seed: VVRVNARVRIAYPSLREAALLEEEE (MAGA4_HUMAN)
  Core: RVRIAYPSL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNAXVRXAXPSXREAALLEEEE

SEQ ID NO: 246647 - protein, 25 aa, Artificial Sequence
  Description of Artificial Sequence: Synthetic peptide
  Seed: VVRVNARVRIAYPSLREAALLEEEE (MAGA4_HUMAN)
  Core: VRIAYPSLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARXRIXYXSLXEAALLEEEE

SEQ ID NO: 246648 - protein, 25 aa, Artificial Sequence
  Description of Artificial Sequence: Synthetic peptide
  Seed: VVRVNARVRIAYPSLREAALLEEEE (MAGA4_HUMAN)
  Core: RIAYPSLRE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVXIAXPXLRXAALLEEEE

SEQ ID NO: 246649 - protein, 25 aa, Artificial Sequence
  Description of Artificial Sequence: Synthetic peptide
  Seed: VVRVNARVRIAYPSLREAALLEEEE (MAGA4_HUMAN)
  Core: IAYPSLREA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRXAYXSXREXALLEEEE

SEQ ID NO: 246650 - protein, 25 aa, Artificial Sequence
  Description of Artificial Sequence: Synthetic peptide
  Seed: VVRVNARVRIAYPSLREAALLEEEE (MAGA4_HUMAN)
  Core: LREAALLEE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRIAYPSXREXAXLEXEE

SEQ ID NO: 246651 - protein, 25 aa, Artificial Sequence
  Description of Artificial Sequence: Synthetic peptide
  Seed: VVRVNARVRIAYPSLREAALLEEEE (MAGA4_HUMAN)
  Core: REAALLEEE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VVRVNARVRIAYPSLXEAXLXEEXE

SEQ ID NO: 246652 - protein, 24 aa, Artificial Sequence
  Description of Artificial Sequence: Synthetic peptide
  Seed: VYDGREHTVYGEPRKLLTQDWVQE (MAGA4_HUMAN)
  Core: VYGEPRKLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VYDGREHTXYGXPXKLXTQDWVQE

SEQ ID NO: 246653 - protein, 25 aa, Artificial Sequence
  Description of Artificial Sequence: Synthetic peptide
  Seed: VYDGREHTVYGEPRKLLTQDWVQEN (MAGA4_HUMAN)
  Core: VYGEPRKLL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VYDGREHTXYGXPXKLXTQDWVQEN

SEQ ID NO: 246654 - protein, 25 aa, Artificial Sequence
  Description of Artificial Sequence: Synthetic peptide
  Seed: VYDGREHTVYGEPRKLLTQDWVQEN (MAGA4_HUMAN)
  Core: LLTQDWVQE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VYDGREHTVYGEPRKXLTXDXVQXN

SEQ ID NO: 246655 - protein, 16 aa, Artificial Sequence
  Description of Artificial Sequence: Synthetic peptide
  Seed: VYGEPRKLLTQDWVQE (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQX

SEQ ID NO: 246656 - protein, 17 aa, Artificial Sequence
  Description of Artificial Sequence: Synthetic peptide
  Seed: VYGEPRKLLTQDWVQEN (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXN

SEQ ID NO: 246657 - protein, 18 aa, Artificial Sequence
  Description of Artificial Sequence: Synthetic peptide
  Seed: VYGEPRKLLTQDWVQENY (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXNY

SEQ ID NO: 246658 - protein, 19 aa, Artificial Sequence
  Description of Artificial Sequence: Synthetic peptide
  Seed: VYGEPRKLLTQDWVQENYL (MAGA4_HUMAN)
  Core: KLLTQDWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRXLLXQXWVXENYL

SEQ ID NO: 246659 - protein, 19 aa, Artificial Sequence
  Description of Artificial Sequence: Synthetic peptide
  Seed: VYGEPRKLLTQDWVQENYL (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXNYL

SEQ ID NO: 246660 - protein, 20 aa, Artificial Sequence
  Description of Artificial Sequence: Synthetic peptide
  Seed: VYGEPRKLLTQDWVQENYLE (MAGA4_HUMAN)
  Core: RKLLTQDWV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPXKLXTXDWXQENYLE

SEQ ID NO: 246661 - protein, 20 aa, Artificial Sequence
  Description of Artificial Sequence: Synthetic peptide
  Seed: VYGEPRKLLTQDWVQENYLE (MAGA4_HUMAN)
  Core: KLLTQDWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRXLLXQXWVXENYLE

SEQ ID NO: 246662 - protein, 20 aa, Artificial Sequence
  Description of Artificial Sequence: Synthetic peptide
  Seed: VYGEPRKLLTQDWVQENYLE (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXNYLE

SEQ ID NO: 246663 - protein, 20 aa, Artificial Sequence
  Description of Artificial Sequence: Synthetic peptide
  Seed: VYGEPRKLLTQDWVQENYLE (MAGA4_HUMAN)
  Core: LTQDWVQEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLXTQXWXQEXYLE

SEQ ID NO: 246664 - protein, 21 aa, Artificial Sequence
  Description of Artificial Sequence: Synthetic peptide
  Seed: VYGEPRKLLTQDWVQENYLEY (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXNYLEY

SEQ ID NO: 246665 - protein, 21 aa, Artificial Sequence
  Description of Artificial Sequence: Synthetic peptide
  Seed: VYGEPRKLLTQDWVQENYLEY (MAGA4_HUMAN)
  Core: LTQDWVQEN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLXTQXWXQEXYLEY

SEQ ID NO: 246666 - protein, 21 aa, Artificial Sequence
  Description of Artificial Sequence: Synthetic peptide
  Seed: VYGEPRKLLTQDWVQENYLEY (MAGA4_HUMAN)
  Core: WVQENYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLLTQDXVQXNXLEX

SEQ ID NO: 246667 - protein, 22 aa, Artificial Sequence
  Description of Artificial Sequence: Synthetic peptide
  Seed: VYGEPRKLLTQDWVQENYLEYR (MAGA4_HUMAN)
  Core: LLTQDWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKXLTXDXVQXNYLEYR

SEQ ID NO: 246668 - protein, 22 aa, Artificial Sequence
  Description of Artificial Sequence: Synthetic peptide
  Seed: VYGEPRKLLTQDWVQENYLEYR (MAGA4_HUMAN)
  Core: WVQENYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLLTQDXVQXNXLEXR

SEQ ID NO: 246669 - protein, 23 aa, Artificial Sequence
  Description of Artificial Sequence: Synthetic peptide
  Seed: VYGEPRKLLTQDWVQENYLEYRQ (MAGA4_HUMAN)
  Core: WVQENYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLLTQDXVQXNXLEXRQ

SEQ ID NO: 246670 - protein, 24 aa, Artificial Sequence
  Description of Artificial Sequence: Synthetic peptide
  Seed: VYGEPRKLLTQDWVQENYLEYRQV (MAGA4_HUMAN)
  Core: WVQENYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLLTQDXVQXNXLEXRQV

SEQ ID NO: 246671 - protein, 25 aa, Artificial Sequence
  Description of Artificial Sequence: Synthetic peptide
  Seed: VYGEPRKLLTQDWVQENYLEYRQVP (MAGA4_HUMAN)
  Core: WVQENYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYGEPRKLLTQDXVQXNXLEXRQVP

SEQ ID NO: 246672 - protein, 14 aa, Artificial Sequence
  Description of Artificial Sequence: Synthetic peptide
  Seed: WEELGVMGVYDGRE (MAGA4_HUMAN)
  Core: LGVMGVYDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WEEXGVXGXYDXRE

SEQ ID NO: 246673 - protein, 15 aa, Artificial Sequence
  Description of Artificial Sequence: Synthetic peptide
  Seed: WEELGVMGVYDGREH (MAGA4_HUMAN)
  Core: LGVMGVYDG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WEEXGVXGXYDXREH

SEQ ID NO: 246674 - protein, 15 aa, Artificial Sequence
  Description of Artificial Sequence: Synthetic peptide
  Seed: WEELGVMGVYDGREH (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXH

SEQ ID NO: 246675 - protein, 16 aa, Artificial Sequence
  Description of Artificial Sequence: Synthetic peptide
  Seed: WEELGVMGVYDGREHT (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHT

SEQ ID NO: 246676 - protein, 17 aa, Artificial Sequence
  Description of Artificial Sequence: Synthetic peptide
  Seed: WEELGVMGVYDGREHTV (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTV

SEQ ID NO: 246677 - protein, 18 aa, Artificial Sequence
  Description of Artificial Sequence: Synthetic peptide
  Seed: WEELGVMGVYDGREHTVY (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVY

SEQ ID NO: 246678 - protein, 19 aa, Artificial Sequence
  Description of Artificial Sequence: Synthetic peptide
  Seed: WEELGVMGVYDGREHTVYG (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYG

SEQ ID NO: 246679 - protein, 20 aa, Artificial Sequence
  Description of Artificial Sequence: Synthetic peptide
  Seed: WEELGVMGVYDGREHTVYGE (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGE

SEQ ID NO: 246680 - protein, 21 aa, Artificial Sequence
  Description of Artificial Sequence: Synthetic peptide
  Seed: WEELGVMGVYDGREHTVYGEP (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGEP

SEQ ID NO: 246681 - protein, 22 aa, Artificial Sequence
  Description of Artificial Sequence: Synthetic peptide
  Seed: WEELGVMGVYDGREHTVYGEPR (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGEPR

SEQ ID NO: 246682 - protein, 23 aa, Artificial Sequence
  Description of Artificial Sequence: Synthetic peptide
  Seed: WEELGVMGVYDGREHTVYGEPRK (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGEPRK

SEQ ID NO: 246683 - protein, 24 aa, Artificial Sequence
  Description of Artificial Sequence: Synthetic peptide
  Seed: WEELGVMGVYDGREHTVYGEPRKL (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGEPRKL

SEQ ID NO: 246684 - protein, 25 aa, Artificial Sequence
  Description of Artificial Sequence: Synthetic peptide
  Seed: WEELGVMGVYDGREHTVYGEPRKLL (MAGA4_HUMAN)
  Core: VMGVYDGRE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WEELGXMGXYXGRXHTVYGEPRKLL

SEQ ID NO: 246685 - protein, 17 aa, Artificial Sequence
  Description of Artificial Sequence: Synthetic peptide
  Seed: WGPRALAETSYVKVLEH (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEH

SEQ ID NO: 246686 - protein, 17 aa, Artificial Sequence
  Description of Artificial Sequence: Synthetic peptide
  Seed: WGPRALAETSYVKVLEH (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEH

SEQ ID NO: 246687 - protein, 17 aa, Artificial Sequence
  Description of Artificial Sequence: Synthetic peptide
  Seed: WGPRALAETSYVKVLEH (MAGA4_HUMAN)
  Core: AETSYVKVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALXETXYXKVXEH

SEQ ID NO: 246688 - protein, 18 aa, Artificial Sequence
  Description of Artificial Sequence: Synthetic peptide
  Seed: WGPRALAETSYVKVLEHV (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHV

SEQ ID NO: 246689 - protein, 19 aa, Artificial Sequence
  Description of Artificial Sequence: Synthetic peptide
  Seed: WGPRALAETSYVKVLEHVV (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEHVV

SEQ ID NO: 246690 - protein, 19 aa, Artificial Sequence
  Description of Artificial Sequence: Synthetic peptide
  Seed: WGPRALAETSYVKVLEHVV (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVV

SEQ ID NO: 246691 - protein, 19 aa, Artificial Sequence
  Description of Artificial Sequence: Synthetic peptide
  Seed: WGPRALAETSYVKVLEHVV (MAGA4_HUMAN)
  Core: AETSYVKVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALXETXYXKVXEHVV

SEQ ID NO: 246692 - protein, 19 aa, Artificial Sequence
  Description of Artificial Sequence: Synthetic peptide
  Seed: WGPRALAETSYVKVLEHVV (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVV

SEQ ID NO: 246693 - protein, 20 aa, Artificial Sequence
  Description of Artificial Sequence: Synthetic peptide
  Seed: WGPRALAETSYVKVLEHVVR (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEHVVR

SEQ ID NO: 246694 - protein, 20 aa, Artificial Sequence
  Description of Artificial Sequence: Synthetic peptide
  Seed: WGPRALAETSYVKVLEHVVR (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVR

SEQ ID NO: 246695 - protein, 20 aa, Artificial Sequence
  Description of Artificial Sequence: Synthetic peptide
  Seed: WGPRALAETSYVKVLEHVVR (MAGA4_HUMAN)
  Core: AETSYVKVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALXETXYXKVXEHVVR

SEQ ID NO: 246696 - protein, 20 aa, Artificial Sequence
  Description of Artificial Sequence: Synthetic peptide
  Seed: WGPRALAETSYVKVLEHVVR (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVR

SEQ ID NO: 246697 - protein, 20 aa, Artificial Sequence
  Description of Artificial Sequence: Synthetic peptide
  Seed: WGPRALAETSYVKVLEHVVR (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXR

SEQ ID NO: 246698 - protein, 20 aa, Artificial Sequence
  Description of Artificial Sequence: Synthetic peptide
  Seed: WGPRALAETSYVKVLEHVVR (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVX

SEQ ID NO: 246699 - protein, 21 aa, Artificial Sequence
  Description of Artificial Sequence: Synthetic peptide
  Seed: WGPRALAETSYVKVLEHVVRV (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEHVVRV

SEQ ID NO: 246700 - protein, 21 aa, Artificial Sequence
  Description of Artificial Sequence: Synthetic peptide
  Seed: WGPRALAETSYVKVLEHVVRV (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVRV

SEQ ID NO: 246701 - protein, 21 aa, Artificial Sequence
  Description of Artificial Sequence: Synthetic peptide
  Seed: WGPRALAETSYVKVLEHVVRV (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVRV

SEQ ID NO: 246702 - protein, 21 aa, Artificial Sequence
  Description of Artificial Sequence: Synthetic peptide
  Seed: WGPRALAETSYVKVLEHVVRV (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXRV

SEQ ID NO: 246703 - protein, 21 aa, Artificial Sequence
  Description of Artificial Sequence: Synthetic peptide
  Seed: WGPRALAETSYVKVLEHVVRV (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVXV

SEQ ID NO: 246704 - protein, 22 aa, Artificial Sequence
  Description of Artificial Sequence: Synthetic peptide
  Seed: WGPRALAETSYVKVLEHVVRVN (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEHVVRVN

SEQ ID NO: 246705 - protein, 22 aa, Artificial Sequence
  Description of Artificial Sequence: Synthetic peptide
  Seed: WGPRALAETSYVKVLEHVVRVN (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVRVN

SEQ ID NO: 246706 - protein, 22 aa, Artificial Sequence
  Description of Artificial Sequence: Synthetic peptide
  Seed: WGPRALAETSYVKVLEHVVRVN (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVRVN

SEQ ID NO: 246707 - protein, 22 aa, Artificial Sequence
  Description of Artificial Sequence: Synthetic peptide
  Seed: WGPRALAETSYVKVLEHVVRVN (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXRVN

SEQ ID NO: 246708 - protein, 22 aa, Artificial Sequence
  Description of Artificial Sequence: Synthetic peptide
  Seed: WGPRALAETSYVKVLEHVVRVN (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVXVN

SEQ ID NO: 246709 - protein, 23 aa, Artificial Sequence
  Description of Artificial Sequence: Synthetic peptide
  Seed: WGPRALAETSYVKVLEHVVRVNA (MAGA4_HUMAN)
  Core: RALAETSYV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGPXALXEXSYXKVLEHVVRVNA

SEQ ID NO: 246710 - protein, 23 aa, Artificial Sequence
  Description of Artificial Sequence: Synthetic peptide
  Seed: WGPRALAETSYVKVLEHVVRVNA (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVRVNA

SEQ ID NO: 246711 - protein, 23 aa, Artificial Sequence
  Description of Artificial Sequence: Synthetic peptide
  Seed: WGPRALAETSYVKVLEHVVRVNA (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVRVNA

SEQ ID NO: 246712 - protein, 23 aa, Artificial Sequence
  Description of Artificial Sequence: Synthetic peptide
  Seed: WGPRALAETSYVKVLEHVVRVNA (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXRVNA

SEQ ID NO: 246713 - protein, 23 aa, Artificial Sequence
  Description of Artificial Sequence: Synthetic peptide
  Seed: WGPRALAETSYVKVLEHVVRVNA (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVXVNA

SEQ ID NO: 246714 - protein, 24 aa, Artificial Sequence
  Description of Artificial Sequence: Synthetic peptide
  Seed: WGPRALAETSYVKVLEHVVRVNAR (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVRVNAR

SEQ ID NO: 246715 - protein, 24 aa, Artificial Sequence
  Description of Artificial Sequence: Synthetic peptide
  Seed: WGPRALAETSYVKVLEHVVRVNAR (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVRVNAR

SEQ ID NO: 246716 - protein, 24 aa, Artificial Sequence
  Description of Artificial Sequence: Synthetic peptide
  Seed: WGPRALAETSYVKVLEHVVRVNAR (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXRVNAR

SEQ ID NO: 246717 - protein, 24 aa, Artificial Sequence
  Description of Artificial Sequence: Synthetic peptide
  Seed: WGPRALAETSYVKVLEHVVRVNAR (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVXVNAR

SEQ ID NO: 246718 - protein, 24 aa, Artificial Sequence
  Description of Artificial Sequence: Synthetic peptide
  Seed: WGPRALAETSYVKVLEHVVRVNAR (MAGA4_HUMAN)
  Core: KVLEHVVRV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYVXVLXHXVRXNAR

SEQ ID NO: 246719 - protein, 24 aa, Artificial Sequence
  Description of Artificial Sequence: Synthetic peptide
  Seed: WGPRALAETSYVKVLEHVVRVNAR (MAGA4_HUMAN)
  Core: LEHVVRVNA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYVKVXEHXVXVNXR

SEQ ID NO: 246720 - protein, 25 aa, Artificial Sequence
  Description of Artificial Sequence: Synthetic peptide
  Seed: WGPRALAETSYVKVLEHVVRVNARV (MAGA4_HUMAN)
  Core: LAETSYVKV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WGPRAXAEXSXVKXLEHVVRVNARV

SEQ ID NO: 246721 - protein, 25 aa, Artificial Sequence
  Description of Artificial Sequence: Synthetic peptide
  Seed: WGPRALAETSYVKVLEHVVRVNARV (MAGA4_HUMAN)
  Core: TSYVKVLEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAEXSYXKXLEXVVRVNARV

SEQ ID NO: 246722 - protein, 25 aa, Artificial Sequence
  Description of Artificial Sequence: Synthetic peptide
  Seed: WGPRALAETSYVKVLEHVVRVNARV (MAGA4_HUMAN)
  Core: YVKVLEHVV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSXVKXLXHVXRVNARV

SEQ ID NO: 246723 - protein, 25 aa, Artificial Sequence
  Description of Artificial Sequence: Synthetic peptide
  Seed: WGPRALAETSYVKVLEHVVRVNARV (MAGA4_HUMAN)
  Core: VKVLEHVVR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYXKVXEXVVXVNARV

SEQ ID NO: 246724 - protein, 25 aa, Artificial Sequence
  Description of Artificial Sequence: Synthetic peptide
  Seed: WGPRALAETSYVKVLEHVVRVNARV (MAGA4_HUMAN)
  Core: KVLEHVVRV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYVXVLXHXVRXNARV

SEQ ID NO: 246725 - protein, 25 aa, Artificial Sequence
  Description of Artificial Sequence: Synthetic peptide
  Seed: WGPRALAETSYVKVLEHVVRVNARV (MAGA4_HUMAN)
  Core: VLEHVVRVN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYVKXLEXVXRVXARV

SEQ ID NO: 246726 - protein, 25 aa, Artificial Sequence
  Description of Artificial Sequence: Synthetic peptide
  Seed: WGPRALAETSYVKVLEHVVRVNARV (MAGA4_HUMAN)
  Core: LEHVVRVNA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WGPRALAETSYVKVXEHXVXVNXRV

SEQ ID NO: 246727 - protein, 14 aa, Artificial Sequence
  Description of Artificial Sequence: Synthetic peptide
  Seed: WVQENYLEYRQVPG (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPG

SEQ ID NO: 246728 - protein, 15 aa, Artificial Sequence
  Description of Artificial Sequence: Synthetic peptide
  Seed: WVQENYLEYRQVPGS (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGS

SEQ ID NO: 246729 - protein, 16 aa, Artificial Sequence
  Description of Artificial Sequence: Synthetic peptide
  Seed: WVQENYLEYRQVPGSN (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSN

SEQ ID NO: 246730 - protein, 17 aa, Artificial Sequence
  Description of Artificial Sequence: Synthetic peptide
  Seed: WVQENYLEYRQVPGSNP (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSNP

SEQ ID NO: 246731 - protein, 19 aa, Artificial Sequence
  Description of Artificial Sequence: Synthetic peptide
  Seed: WVQENYLEYRQVPGSNPAR (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXAR

SEQ ID NO: 246732 - protein, 20 aa, Artificial Sequence
  Description of Artificial Sequence: Synthetic peptide
  Seed: WVQENYLEYRQVPGSNPARY (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSNPARY

SEQ ID NO: 246733 - protein, 20 aa, Artificial Sequence
  Description of Artificial Sequence: Synthetic peptide
  Seed: WVQENYLEYRQVPGSNPARY (MAGA4_HUMAN)
  Core: YLEYRQVPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WVQENXLEXRXVPXSNPARY

SEQ ID NO: 246734 - protein, 20 aa, Artificial Sequence
  Description of Artificial Sequence: Synthetic peptide
  Seed: WVQENYLEYRQVPGSNPARY (MAGA4_HUMAN)
  Core: LEYRQVPGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYXEYXQXPGXNPARY

SEQ ID NO: 246735 - protein, 20 aa, Artificial Sequence
  Description of Artificial Sequence: Synthetic peptide
  Seed: WVQENYLEYRQVPGSNPARY (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARY

SEQ ID NO: 246736 - protein, 21 aa, Artificial Sequence
  Description of Artificial Sequence: Synthetic peptide
  Seed: WVQENYLEYRQVPGSNPARYE (MAGA4_HUMAN)
  Core: YLEYRQVPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WVQENXLEXRXVPXSNPARYE

SEQ ID NO: 246737 - protein, 21 aa, Artificial Sequence
  Description of Artificial Sequence: Synthetic peptide
  Seed: WVQENYLEYRQVPGSNPARYE (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARYE

SEQ ID NO: 246738 - protein, 22 aa, Artificial Sequence
  Description of Artificial Sequence: Synthetic peptide
  Seed: WVQENYLEYRQVPGSNPARYEF (MAGA4_HUMAN)
  Core: YLEYRQVPG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WVQENXLEXRXVPXSNPARYEF

SEQ ID NO: 246739 - protein, 22 aa, Artificial Sequence
  Description of Artificial Sequence: Synthetic peptide
  Seed: WVQENYLEYRQVPGSNPARYEF (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARYEF

SEQ ID NO: 246740 - protein, 23 aa, Artificial Sequence
  Description of Artificial Sequence: Synthetic peptide
  Seed: WVQENYLEYRQVPGSNPARYEFL (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSNPARYEFL

SEQ ID NO: 246741 - protein, 23 aa, Artificial Sequence
  Description of Artificial Sequence: Synthetic peptide
  Seed: WVQENYLEYRQVPGSNPARYEFL (MAGA4_HUMAN)
  Core: LEYRQVPGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYXEYXQXPGXNPARYEFL

SEQ ID NO: 246742 - protein, 23 aa, Artificial Sequence
  Description of Artificial Sequence: Synthetic peptide
  Seed: WVQENYLEYRQVPGSNPARYEFL (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARYEFL

SEQ ID NO: 246743 - protein, 24 aa, Artificial Sequence
  Description of Artificial Sequence: Synthetic peptide
  Seed: WVQENYLEYRQVPGSNPARYEFLW (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSNPARYEFLW

SEQ ID NO: 246744 - protein, 24 aa, Artificial Sequence
  Description of Artificial Sequence: Synthetic peptide
  Seed: WVQENYLEYRQVPGSNPARYEFLW (MAGA4_HUMAN)
  Core: LEYRQVPGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYXEYXQXPGXNPARYEFLW

SEQ ID NO: 246745 - protein, 24 aa, Artificial Sequence
  Description of Artificial Sequence: Synthetic peptide
  Seed: WVQENYLEYRQVPGSNPARYEFLW (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARYEFLW

SEQ ID NO: 246746 - protein, 25 aa, Artificial Sequence
  Description of Artificial Sequence: Synthetic peptide
  Seed: WVQENYLEYRQVPGSNPARYEFLWG (MAGA4_HUMAN)
  Core: ENYLEYRQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WVQXNYXEXRQXPGSNPARYEFLWG

SEQ ID NO: 246747 - protein, 25 aa, Artificial Sequence
  Description of Artificial Sequence: Synthetic peptide
  Seed: WVQENYLEYRQVPGSNPARYEFLWG (MAGA4_HUMAN)
  Core: LEYRQVPGS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYXEYXQXPGXNPARYEFLWG

SEQ ID NO: 246748 - protein, 25 aa, Artificial Sequence
  Description of Artificial Sequence: Synthetic peptide
  Seed: WVQENYLEYRQVPGSNPARYEFLWG (MAGA4_HUMAN)
  Core: YRQVPGSNP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WVQENYLEXRQXPXSNXARYEFLWG

SEQ ID NO: 246749 - protein, 15 aa, Artificial Sequence
  Description of Artificial Sequence: Synthetic peptide
  Seed: YDGLLGNNQIFPKTG (MAGA4_HUMAN)
  Core: LLGNNQIFP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YDGXLGXNXIFXKTG

SEQ ID NO: 246750 - protein, 19 aa, Artificial Sequence
  Description of Artificial Sequence: Synthetic peptide
  Seed: YDGLLGNNQIFPKTGLLII (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXI

SEQ ID NO: 246751 - protein, 20 aa, Artificial Sequence
  Description of Artificial Sequence: Synthetic peptide
  Seed: YDGLLGNNQIFPKTGLLIIV (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIV

SEQ ID NO: 246752 - protein, 21 aa, Artificial Sequence
  Description of Artificial Sequence: Synthetic peptide
  Seed: YDGLLGNNQIFPKTGLLIIVL (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIVL

SEQ ID NO: 246753 - protein, 22 aa, Artificial Sequence
  Description of Artificial Sequence: Synthetic peptide
  Seed: YDGLLGNNQIFPKTGLLIIVLG (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIVLG

SEQ ID NO: 246754 - protein, 23 aa, Artificial Sequence
  Description of Artificial Sequence: Synthetic peptide
  Seed: YDGLLGNNQIFPKTGLLIIVLGT (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIVLGT

SEQ ID NO: 246755 - protein, 24 aa, Artificial Sequence
  Description of Artificial Sequence: Synthetic peptide
  Seed: YDGLLGNNQIFPKTGLLIIVLGTI (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIVLGTI

SEQ ID NO: 246756 - protein, 25 aa, Artificial Sequence
  Description of Artificial Sequence: Synthetic peptide
  Seed: YDGLLGNNQIFPKTGLLIIVLGTIA (MAGA4_HUMAN)
  Core: IFPKTGLLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YDGLLGNNQXFPXTXLLXIVLGTIA

SEQ ID NO: 246757 - protein, 16 aa, Artificial Sequence
  Description of Artificial Sequence: Synthetic peptide
  Seed: YDGREHTVYGEPRKLL (MAGA4_HUMAN)
  Core: TVYGEPRKL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHXVYXEXRKXL

SEQ ID NO: 246758 - protein, 23 aa, Artificial Sequence
  Description of Artificial Sequence: Synthetic peptide
  Seed: YDGREHTVYGEPRKLLTQDWVQE (MAGA4_HUMAN)
  Core: VYGEPRKLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTXYGXPXKLXTQDWVQE

SEQ ID NO: 246759 - protein, 24 aa, Artificial Sequence
  Description of Artificial Sequence: Synthetic peptide
  Seed: YDGREHTVYGEPRKLLTQDWVQEN (MAGA4_HUMAN)
  Core: VYGEPRKLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTXYGXPXKLXTQDWVQEN

SEQ ID NO: 246760 - protein, 24 aa, Artificial Sequence
  Description of Artificial Sequence: Synthetic peptide
  Seed: YDGREHTVYGEPRKLLTQDWVQEN (MAGA4_HUMAN)
  Core: LLTQDWVQE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTVYGEPRKXLTXDXVQXN

SEQ ID NO: 246761 - protein, 25 aa, Artificial Sequence
  Description of Artificial Sequence: Synthetic peptide
  Seed: YDGREHTVYGEPRKLLTQDWVQENY (MAGA4_HUMAN)
  Core: VYGEPRKLL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTXYGXPXKLXTQDWVQENY

SEQ ID NO: 246762 - protein, 25 aa, Artificial Sequence
  Description of Artificial Sequence: Synthetic peptide
  Seed: YDGREHTVYGEPRKLLTQDWVQENY (MAGA4_HUMAN)
  Core: KLLTQDWVQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTVYGEPRXLLXQXWVXENY

SEQ ID NO: 246763 - protein, 25 aa, Artificial Sequence
  Description of Artificial Sequence: Synthetic peptide
  Seed: YDGREHTVYGEPRKLLTQDWVQENY (MAGA4_HUMAN)
  Core: LLTQDWVQE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YDGREHTVYGEPRKXLTXDXVQXNY

SEQ ID NO: 246764 - protein, 21 aa, Artificial Sequence
  Description of Artificial Sequence: Synthetic peptide
  Seed: YEFLWGPRALAETSYVKVLEH (MAGA4_HUMAN)
  Core: FLWGPRALA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YEXLWXPXALXETSYVKVLEH

SEQ ID NO: 246765 - protein, 21 aa, Artificial Sequence
  Description of Artificial Sequence: Synthetic peptide
  Seed: YEFLWGPRALAETSYVKVLEH (MAGA4_HUMAN)
  Core: PRALAETSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGXRAXAXTSXVKVLEH

SEQ ID NO: 246766 - protein, 21 aa, Artificial Sequence
  Description of Artificial Sequence: Synthetic peptide
  Seed: YEFLWGPRALAETSYVKVLEH (MAGA4_HUMAN)
  Core: RALAETSYV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPXALXEXSYXKVLEH

SEQ ID NO: 246767 - protein, 21 aa, Artificial Sequence
  Description of Artificial Sequence: Synthetic peptide
  Seed: YEFLWGPRALAETSYVKVLEH (MAGA4_HUMAN)
  Core: LAETSYVKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRAXAEXSXVKXLEH

SEQ ID NO: 246768 - protein, 21 aa, Artificial Sequence
  Description of Artificial Sequence: Synthetic peptide
  Seed: YEFLWGPRALAETSYVKVLEH (MAGA4_HUMAN)
  Core: AETSYVKVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALXETXYXKVXEH

SEQ ID NO: 246769 - protein, 22 aa, Artificial Sequence
  Description of Artificial Sequence: Synthetic peptide
  Seed: YEFLWGPRALAETSYVKVLEHV (MAGA4_HUMAN)
  Core: FLWGPRALA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YEXLWXPXALXETSYVKVLEHV

SEQ ID NO: 246770 - protein, 22 aa, Artificial Sequence
  Description of Artificial Sequence: Synthetic peptide
  Seed: YEFLWGPRALAETSYVKVLEHV (MAGA4_HUMAN)
  Core: PRALAETSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGXRAXAXTSXVKVLEHV

SEQ ID NO: 246771 - protein, 22 aa, Artificial Sequence
  Description of Artificial Sequence: Synthetic peptide
  Seed: YEFLWGPRALAETSYVKVLEHV (MAGA4_HUMAN)
  Core: RALAETSYV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPXALXEXSYXKVLEHV

SEQ ID NO: 246772 - protein, 22 aa, Artificial Sequence
  Description of Artificial Sequence: Synthetic peptide
  Seed: YEFLWGPRALAETSYVKVLEHV (MAGA4_HUMAN)
  Core: LAETSYVKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRAXAEXSXVKXLEHV

SEQ ID NO: 246773 - protein, 22 aa, Artificial Sequence
  Description of Artificial Sequence: Synthetic peptide
  Seed: YEFLWGPRALAETSYVKVLEHV (MAGA4_HUMAN)
  Core: AETSYVKVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALXETXYXKVXEHV

SEQ ID NO: 246774 - protein, 23 aa, Artificial Sequence
  Description of Artificial Sequence: Synthetic peptide
  Seed: YEFLWGPRALAETSYVKVLEHVV (MAGA4_HUMAN)
  Core: FLWGPRALA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YEXLWXPXALXETSYVKVLEHVV

SEQ ID NO: 246775 - protein, 23 aa, Artificial Sequence
  Description of Artificial Sequence: Synthetic peptide
  Seed: YEFLWGPRALAETSYVKVLEHVV (MAGA4_HUMAN)
  Core: PRALAETSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGXRAXAXTSXVKVLEHVV

SEQ ID NO: 246776 - protein, 23 aa, Artificial Sequence
  Description of Artificial Sequence: Synthetic peptide
  Seed: YEFLWGPRALAETSYVKVLEHVV (MAGA4_HUMAN)
  Core: RALAETSYV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPXALXEXSYXKVLEHVV

SEQ ID NO: 246777 - protein, 23 aa, Artificial Sequence
  Description of Artificial Sequence: Synthetic peptide
  Seed: YEFLWGPRALAETSYVKVLEHVV (MAGA4_HUMAN)
  Core: LAETSYVKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRAXAEXSXVKXLEHVV

SEQ ID NO: 246778 - protein, 23 aa, Artificial Sequence
  Description of Artificial Sequence: Synthetic peptide
  Seed: YEFLWGPRALAETSYVKVLEHVV (MAGA4_HUMAN)
  Core: AETSYVKVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALXETXYXKVXEHVV

SEQ ID NO: 246779 - protein, 23 aa, Artificial Sequence
  Description of Artificial Sequence: Synthetic peptide
  Seed: YEFLWGPRALAETSYVKVLEHVV (MAGA4_HUMAN)
  Core: TSYVKVLEH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAEXSYXKXLEXVV

SEQ ID NO: 246780 - protein, 23 aa, Artificial Sequence
  Description of Artificial Sequence: Synthetic peptide
  Seed: YEFLWGPRALAETSYVKVLEHVV (MAGA4_HUMAN)
  Core: YVKVLEHVV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAETSXVKXLXHVX

SEQ ID NO: 246781 - protein, 24 aa, Artificial Sequence
  Description of Artificial Sequence: Synthetic peptide
  Seed: YEFLWGPRALAETSYVKVLEHVVR (MAGA4_HUMAN)
  Core: FLWGPRALA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YEXLWXPXALXETSYVKVLEHVVR

SEQ ID NO: 246782 - protein, 24 aa, Artificial Sequence
  Description of Artificial Sequence: Synthetic peptide
  Seed: YEFLWGPRALAETSYVKVLEHVVR (MAGA4_HUMAN)
  Core: RALAETSYV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPXALXEXSYXKVLEHVVR

SEQ ID NO: 246783 - protein, 24 aa, Artificial Sequence
  Description of Artificial Sequence: Synthetic peptide
  Seed: YEFLWGPRALAETSYVKVLEHVVR (MAGA4_HUMAN)
  Core: LAETSYVKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRAXAEXSXVKXLEHVVR

SEQ ID NO: 246784 - protein, 24 aa, Artificial Sequence
  Description of Artificial Sequence: Synthetic peptide
  Seed: YEFLWGPRALAETSYVKVLEHVVR (MAGA4_HUMAN)
  Core: AETSYVKVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALXETXYXKVXEHVVR

SEQ ID NO: 246785 - protein, 24 aa, Artificial Sequence
  Description of Artificial Sequence: Synthetic peptide
  Seed: YEFLWGPRALAETSYVKVLEHVVR (MAGA4_HUMAN)
  Core: TSYVKVLEH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAEXSYXKXLEXVVR

SEQ ID NO: 246786 - protein, 24 aa, Artificial Sequence
  Description of Artificial Sequence: Synthetic peptide
  Seed: YEFLWGPRALAETSYVKVLEHVVR (MAGA4_HUMAN)
  Core: YVKVLEHVV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAETSXVKXLXHVXR

SEQ ID NO: 246787 - protein, 25 aa, Artificial Sequence
  Description of Artificial Sequence: Synthetic peptide
  Seed: YEFLWGPRALAETSYVKVLEHVVRV (MAGA4_HUMAN)
  Core: FLWGPRALA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YEXLWXPXALXETSYVKVLEHVVRV

SEQ ID NO: 246788 - protein, 25 aa, Artificial Sequence
  Description of Artificial Sequence: Synthetic peptide
  Seed: YEFLWGPRALAETSYVKVLEHVVRV (MAGA4_HUMAN)
  Core: RALAETSYV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPXALXEXSYXKVLEHVVRV

SEQ ID NO: 246789 - protein, 25 aa, Artificial Sequence
  Description of Artificial Sequence: Synthetic peptide
  Seed: YEFLWGPRALAETSYVKVLEHVVRV (MAGA4_HUMAN)
  Core: LAETSYVKV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRAXAEXSXVKXLEHVVRV

SEQ ID NO: 246790 - protein, 25 aa, Artificial Sequence
  Description of Artificial Sequence: Synthetic peptide
  Seed: YEFLWGPRALAETSYVKVLEHVVRV (MAGA4_HUMAN)
  Core: AETSYVKVL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALXETXYXKVXEHVVRV

SEQ ID NO: 246791 - protein, 25 aa, Artificial Sequence
  Description of Artificial Sequence: Synthetic peptide
  Seed: YEFLWGPRALAETSYVKVLEHVVRV (MAGA4_HUMAN)
  Core: ETSYVKVLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAXTSXVXVLXHVVRV

SEQ ID NO: 246792 - protein, 25 aa, Artificial Sequence
  Description of Artificial Sequence: Synthetic peptide
  Seed: YEFLWGPRALAETSYVKVLEHVVRV (MAGA4_HUMAN)
  Core: TSYVKVLEH
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAEXSYXKXLEXVVRV

SEQ ID NO: 246793 - protein, 25 aa, Artificial Sequence
  Description of Artificial Sequence: Synthetic peptide
  Seed: YEFLWGPRALAETSYVKVLEHVVRV (MAGA4_HUMAN)
  Core: YVKVLEHVV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAETSXVKXLXHVXRV

SEQ ID NO: 246794 - protein, 25 aa, Artificial Sequence
  Description of Artificial Sequence: Synthetic peptide
  Seed: YEFLWGPRALAETSYVKVLEHVVRV (MAGA4_HUMAN)
  Core: VKVLEHVVR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YEFLWGPRALAETSYXKVXEXVVXV

SEQ ID NO: 246795 - protein, 16 aa, Artificial Sequence
  Description of Artificial Sequence: Synthetic peptide
  Seed: YGEPRKLLTQDWVQEN (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXN

SEQ ID NO: 246796 - protein, 17 aa, Artificial Sequence
  Description of Artificial Sequence: Synthetic peptide
  Seed: YGEPRKLLTQDWVQENY (MAGA4_HUMAN)
  Core: KLLTQDWVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRXLLXQXWVXENY

SEQ ID NO: 246797 - protein, 17 aa, Artificial Sequence
  Description of Artificial Sequence: Synthetic peptide
  Seed: YGEPRKLLTQDWVQENY (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXNY

SEQ ID NO: 246798 - protein, 18 aa, Artificial Sequence
  Description of Artificial Sequence: Synthetic peptide
  Seed: YGEPRKLLTQDWVQENYL (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXNYL

SEQ ID NO: 246799 - protein, 19 aa, Artificial Sequence
  Description of Artificial Sequence: Synthetic peptide
  Seed: YGEPRKLLTQDWVQENYLE (MAGA4_HUMAN)
  Core: KLLTQDWVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRXLLXQXWVXENYLE

SEQ ID NO: 246800 - protein, 19 aa, Artificial Sequence
  Description of Artificial Sequence: Synthetic peptide
  Seed: YGEPRKLLTQDWVQENYLE (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXNYLE

SEQ ID NO: 246801 - protein, 20 aa, Artificial Sequence
  Description of Artificial Sequence: Synthetic peptide
  Seed: YGEPRKLLTQDWVQENYLEY (MAGA4_HUMAN)
  Core: RKLLTQDWV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YGEPXKLXTXDWXQENYLEY

SEQ ID NO: 246802 - protein, 20 aa, Artificial Sequence
  Description of Artificial Sequence: Synthetic peptide
  Seed: YGEPRKLLTQDWVQENYLEY (MAGA4_HUMAN)
  Core: KLLTQDWVQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRXLLXQXWVXENYLEY

SEQ ID NO: 246803 - protein, 20 aa, Artificial Sequence
  Description of Artificial Sequence: Synthetic peptide
  Seed: YGEPRKLLTQDWVQENYLEY (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXNYLEY

SEQ ID NO: 246804 - protein, 20 aa, Artificial Sequence
  Description of Artificial Sequence: Synthetic peptide
  Seed: YGEPRKLLTQDWVQENYLEY (MAGA4_HUMAN)
  Core: LTQDWVQEN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLXTQXWXQEXYLEY

SEQ ID NO: 246805 - protein, 20 aa, Artificial Sequence
  Description of Artificial Sequence: Synthetic peptide
  Seed: YGEPRKLLTQDWVQENYLEY (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEX

SEQ ID NO: 246806 - protein, 21 aa, Artificial Sequence
  Description of Artificial Sequence: Synthetic peptide
  Seed: YGEPRKLLTQDWVQENYLEYR (MAGA4_HUMAN)
  Core: LLTQDWVQE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKXLTXDXVQXNYLEYR

SEQ ID NO: 246807 - protein, 21 aa, Artificial Sequence
  Description of Artificial Sequence: Synthetic peptide
  Seed: YGEPRKLLTQDWVQENYLEYR (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEXR

SEQ ID NO: 246808 - protein, 22 aa, Artificial Sequence
  Description of Artificial Sequence: Synthetic peptide
  Seed: YGEPRKLLTQDWVQENYLEYRQ (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEXRQ

SEQ ID NO: 246809 - protein, 23 aa, Artificial Sequence
  Description of Artificial Sequence: Synthetic peptide
  Seed: YGEPRKLLTQDWVQENYLEYRQV (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEXRQV

SEQ ID NO: 246810 - protein, 24 aa, Artificial Sequence
  Description of Artificial Sequence: Synthetic peptide
  Seed: YGEPRKLLTQDWVQENYLEYRQVP (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEXRQVP

SEQ ID NO: 246811 - protein, 25 aa, Artificial Sequence
  Description of Artificial Sequence: Synthetic peptide
  Seed: YGEPRKLLTQDWVQENYLEYRQVPG (MAGA4_HUMAN)
  Core: WVQENYLEY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDXVQXNXLEXRQVPG

SEQ ID NO: 246812 - protein, 25 aa, Artificial Sequence
  Description of Artificial Sequence: Synthetic peptide
  Seed: YGEPRKLLTQDWVQENYLEYRQVPG (MAGA4_HUMAN)
  Core: QENYLEYRQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YGEPRKLLTQDWVXENXLXYRXVPG

SEQ ID NO: 246813 - protein, 13 aa, Artificial Sequence
  Description of Artificial Sequence: Synthetic peptide
  Seed: YKRCFPVIFGKAS (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXS

SEQ ID NO: 246814 - protein, 14 aa, Artificial Sequence
  Description of Artificial Sequence: Synthetic peptide
  Seed: YKRCFPVIFGKASE (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXSE

SEQ ID NO: 246815 - protein, 14 aa, Artificial Sequence
  Description of Artificial Sequence: Synthetic peptide
  Seed: YKRCFPVIFGKASE (MAGA4_HUMAN)
  Core: FPVIFGKAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKRCXPVXFXKAXE

SEQ ID NO: 246816 - protein, 15 aa, Artificial Sequence
  Description of Artificial Sequence: Synthetic peptide
  Seed: YKRCFPVIFGKASES (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXSES

SEQ ID NO: 246817 - protein, 15 aa, Artificial Sequence
  Description of Artificial Sequence: Synthetic peptide
  Seed: YKRCFPVIFGKASES (MAGA4_HUMAN)
  Core: FPVIFGKAS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YKRCXPVXFXKAXES

SEQ ID NO: 246818 - protein, 15 aa, Artificial Sequence
  Description of Artificial Sequence: Synthetic peptide
  Seed: YKRCFPVIFGKASES (MAGA4_HUMAN)
  Core: PVIFGKASE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFXVIXGXASXS

SEQ ID NO: 246819 - protein, 15 aa, Artificial Sequence
  Description of Artificial Sequence: Synthetic peptide
  Seed: YKRCFPVIFGKASES (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEX

SEQ ID NO: 246820 - protein, 16 aa, Artificial Sequence
  Description of Artificial Sequence: Synthetic peptide
  Seed: YKRCFPVIFGKASESL (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXSESL

SEQ ID NO: 246821 - protein, 16 aa, Artificial Sequence
  Description of Artificial Sequence: Synthetic peptide
  Seed: YKRCFPVIFGKASESL (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXL

SEQ ID NO: 246822 - protein, 16 aa, Artificial Sequence
  Description of Artificial Sequence: Synthetic peptide
  Seed: YKRCFPVIFGKASESL (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESX

SEQ ID NO: 246823 - protein, 17 aa, Artificial Sequence
  Description of Artificial Sequence: Synthetic peptide
  Seed: YKRCFPVIFGKASESLK (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXSESLK

SEQ ID NO: 246824 - protein, 17 aa, Artificial Sequence
  Description of Artificial Sequence: Synthetic peptide
  Seed: YKRCFPVIFGKASESLK (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLK

SEQ ID NO: 246825 - protein, 17 aa, Artificial Sequence
  Description of Artificial Sequence: Synthetic peptide
  Seed: YKRCFPVIFGKASESLK (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXK

SEQ ID NO: 246826 - protein, 18 aa, Artificial Sequence
  Description of Artificial Sequence: Synthetic peptide
  Seed: YKRCFPVIFGKASESLKM (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKM

SEQ ID NO: 246827 - protein, 18 aa, Artificial Sequence
  Description of Artificial Sequence: Synthetic peptide
  Seed: YKRCFPVIFGKASESLKM (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKM

SEQ ID NO: 246828 - protein, 19 aa, Artificial Sequence
  Description of Artificial Sequence: Synthetic peptide
  Seed: YKRCFPVIFGKASESLKMI (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMI

SEQ ID NO: 246829 - protein, 19 aa, Artificial Sequence
  Description of Artificial Sequence: Synthetic peptide
  Seed: YKRCFPVIFGKASESLKMI (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMI

SEQ ID NO: 246830 - protein, 20 aa, Artificial Sequence
  Description of Artificial Sequence: Synthetic peptide
  Seed: YKRCFPVIFGKASESLKMIF (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIF

SEQ ID NO: 246831 - protein, 20 aa, Artificial Sequence
  Description of Artificial Sequence: Synthetic peptide
  Seed: YKRCFPVIFGKASESLKMIF (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIF

SEQ ID NO: 246832 - protein, 21 aa, Artificial Sequence
  Description of Artificial Sequence: Synthetic peptide
  Seed: YKRCFPVIFGKASESLKMIFG (MAGA4_HUMAN)
  Core: CFPVIFGKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YKRXFPXIXGKXSESLKMIFG

SEQ ID NO: 246833 - protein, 21 aa, Artificial Sequence
  Description of Artificial Sequence: Synthetic peptide
  Seed: YKRCFPVIFGKASESLKMIFG (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIFG

SEQ ID NO: 246834 - protein, 21 aa, Artificial Sequence
  Description of Artificial Sequence: Synthetic peptide
  Seed: YKRCFPVIFGKASESLKMIFG (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIFG

SEQ ID NO: 246835 - protein, 21 aa, Artificial Sequence
  Description of Artificial Sequence: Synthetic peptide
  Seed: YKRCFPVIFGKASESLKMIFG (MAGA4_HUMAN)
  Core: KASESLKMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGXASXSXKMXFG

SEQ ID NO: 246836 - protein, 22 aa, Artificial Sequence
  Description of Artificial Sequence: Synthetic peptide
  Seed: YKRCFPVIFGKASESLKMIFGI (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIFGI

SEQ ID NO: 246837 - protein, 22 aa, Artificial Sequence
  Description of Artificial Sequence: Synthetic peptide
  Seed: YKRCFPVIFGKASESLKMIFGI (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIFGI

SEQ ID NO: 246838 - protein, 22 aa, Artificial Sequence
  Description of Artificial Sequence: Synthetic peptide
  Seed: YKRCFPVIFGKASESLKMIFGI (MAGA4_HUMAN)
  Core: KASESLKMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGXASXSXKMXFGI

SEQ ID NO: 246839 - protein, 23 aa, Artificial Sequence
  Description of Artificial Sequence: Synthetic peptide
  Seed: YKRCFPVIFGKASESLKMIFGID (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIFGID

SEQ ID NO: 246840 - protein, 23 aa, Artificial Sequence
  Description of Artificial Sequence: Synthetic peptide
  Seed: YKRCFPVIFGKASESLKMIFGID (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIFGID

SEQ ID NO: 246841 - protein, 23 aa, Artificial Sequence
  Description of Artificial Sequence: Synthetic peptide
  Seed: YKRCFPVIFGKASESLKMIFGID (MAGA4_HUMAN)
  Core: KASESLKMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGXASXSXKMXFGID

SEQ ID NO: 246842 - protein, 24 aa, Artificial Sequence
  Description of Artificial Sequence: Synthetic peptide
  Seed: YKRCFPVIFGKASESLKMIFGIDV (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIFGIDV

SEQ ID NO: 246843 - protein, 24 aa, Artificial Sequence
  Description of Artificial Sequence: Synthetic peptide
  Seed: YKRCFPVIFGKASESLKMIFGIDV (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIFGIDV

SEQ ID NO: 246844 - protein, 24 aa, Artificial Sequence
  Description of Artificial Sequence: Synthetic peptide
  Seed: YKRCFPVIFGKASESLKMIFGIDV (MAGA4_HUMAN)
  Core: GKASESLKM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFXKAXEXLKXIFGIDV

SEQ ID NO: 246845 - protein, 24 aa, Artificial Sequence
  Description of Artificial Sequence: Synthetic peptide
  Seed: YKRCFPVIFGKASESLKMIFGIDV (MAGA4_HUMAN)
  Core: KASESLKMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGXASXSXKMXFGIDV

SEQ ID NO: 246846 - protein, 25 aa, Artificial Sequence
  Description of Artificial Sequence: Synthetic peptide
  Seed: YKRCFPVIFGKASESLKMIFGIDVK (MAGA4_HUMAN)
  Core: VIFGKASES
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPXIFXKXSEXLKMIFGIDVK

SEQ ID NO: 246847 - protein, 25 aa, Artificial Sequence
  Description of Artificial Sequence: Synthetic peptide
  Seed: YKRCFPVIFGKASESLKMIFGIDVK (MAGA4_HUMAN)
  Core: IFGKASESL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVXFGXAXESXKMIFGIDVK

SEQ ID NO: 246848 - protein, 25 aa, Artificial Sequence
  Description of Artificial Sequence: Synthetic peptide
  Seed: YKRCFPVIFGKASESLKMIFGIDVK (MAGA4_HUMAN)
  Core: GKASESLKM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFXKAXEXLKXIFGIDVK

SEQ ID NO: 246849 - protein, 25 aa, Artificial Sequence
  Description of Artificial Sequence: Synthetic peptide
  Seed: YKRCFPVIFGKASESLKMIFGIDVK (MAGA4_HUMAN)
  Core: KASESLKMI
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGXASXSXKMXFGIDVK

SEQ ID NO: 246850 - protein, 25 aa, Artificial Sequence
  Description of Artificial Sequence: Synthetic peptide
  Seed: YKRCFPVIFGKASESLKMIFGIDVK (MAGA4_HUMAN)
  Core: LKMIFGIDV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YKRCFPVIFGKASESXKMXFXIDXK

SEQ ID NO: 246851 - protein, 14 aa, Artificial Sequence
  Description of Artificial Sequence: Synthetic peptide
  Seed: YLEYRQVPGSNPAR (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXAR

SEQ ID NO: 246852 - protein, 15 aa, Artificial Sequence
  Description of Artificial Sequence: Synthetic peptide
  Seed: YLEYRQVPGSNPARY (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARY

SEQ ID NO: 246853 - protein, 16 aa, Artificial Sequence
  Description of Artificial Sequence: Synthetic peptide
  Seed: YLEYRQVPGSNPARYE (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYE

SEQ ID NO: 246854 - protein, 17 aa, Artificial Sequence
  Description of Artificial Sequence: Synthetic peptide
  Seed: YLEYRQVPGSNPARYEF (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYEF

SEQ ID NO: 246855 - protein, 19 aa, Artificial Sequence
  Description of Artificial Sequence: Synthetic peptide
  Seed: YLEYRQVPGSNPARYEFLW (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYEFLW

SEQ ID NO: 246856 - protein, 20 aa, Artificial Sequence
  Description of Artificial Sequence: Synthetic peptide
  Seed: YLEYRQVPGSNPARYEFLWG (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYEFLWG

SEQ ID NO: 246857 - protein, 20 aa, Artificial Sequence
  Description of Artificial Sequence: Synthetic peptide
  Seed: YLEYRQVPGSNPARYEFLWG (MAGA4_HUMAN)
  Core: VPGSNPARY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YLEYRQXPGXNXARXEFLWG

SEQ ID NO: 246858 - protein, 21 aa, Artificial Sequence
  Description of Artificial Sequence: Synthetic peptide
  Seed: YLEYRQVPGSNPARYEFLWGP (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYEFLWGP

SEQ ID NO: 246859 - protein, 22 aa, Artificial Sequence
  Description of Artificial Sequence: Synthetic peptide
  Seed: YLEYRQVPGSNPARYEFLWGPR (MAGA4_HUMAN)
  Core: YRQVPGSNP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YLEXRQXPXSNXARYEFLWGPR

SEQ ID NO: 246860 - protein, 23 aa, Artificial Sequence
  Description of Artificial Sequence: Synthetic peptide
  Seed: YLEYRQVPGSNPARYEFLWGPRA (MAGA4_HUMAN)
  Core: YEFLWGPRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YLEYRQVPGSNPARXEFXWXPRX

SEQ ID NO: 246861 - protein, 24 aa, Artificial Sequence
  Description of Artificial Sequence: Synthetic peptide
  Seed: YLEYRQVPGSNPARYEFLWGPRAL (MAGA4_HUMAN)
  Core: RQVPGSNPA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YLEYXQVXGXNPXRYEFLWGPRAL

SEQ ID NO: 246862 - protein, 24 aa, Artificial Sequence
  Description of Artificial Sequence: Synthetic peptide
  Seed: YLEYRQVPGSNPARYEFLWGPRAL (MAGA4_HUMAN)
  Core: YEFLWGPRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YLEYRQVPGSNPARXEFXWXPRXL

SEQ ID NO: 246863 - protein, 25 aa, Artificial Sequence
  Description of Artificial Sequence: Synthetic peptide
  Seed: YLEYRQVPGSNPARYEFLWGPRALA (MAGA4_HUMAN)
  Core: RQVPGSNPA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YLEYXQVXGXNPXRYEFLWGPRALA

SEQ ID NO: 246864 - protein, 25 aa, Artificial Sequence
  Description of Artificial Sequence: Synthetic peptide
  Seed: YLEYRQVPGSNPARYEFLWGPRALA (MAGA4_HUMAN)
  Core: SNPARYEFL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YLEYRQVPGXNPXRXEFXWGPRALA

SEQ ID NO: 246865 - protein, 25 aa, Artificial Sequence
  Description of Artificial Sequence: Synthetic peptide
  Seed: YLEYRQVPGSNPARYEFLWGPRALA (MAGA4_HUMAN)
  Core: YEFLWGPRA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YLEYRQVPGSNPARXEFXWXPRXLA

SEQ ID NO: 246866 - protein, 13 aa, Artificial Sequence
  Description of Artificial Sequence: Synthetic peptide
  Seed: YPSLREAALLEEE (MAGA4_HUMAN)
  Core: LREAALLEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YPSXREXAXLEXE

SEQ ID NO: 246867 - protein, 14 aa, Artificial Sequence
  Description of Artificial Sequence: Synthetic peptide
  Seed: YPSLREAALLEEEE (MAGA4_HUMAN)
  Core: LREAALLEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YPSXREXAXLEXEE

SEQ ID NO: 246868 - protein, 14 aa, Artificial Sequence
  Description of Artificial Sequence: Synthetic peptide
  Seed: YPSLREAALLEEEE (MAGA4_HUMAN)
  Core: REAALLEEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YPSLXEAXLXEEXE

SEQ ID NO: 246869 - protein, 15 aa, Artificial Sequence
  Description of Artificial Sequence: Synthetic peptide
  Seed: YPSLREAALLEEEEG (MAGA4_HUMAN)
  Core: LREAALLEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YPSXREXAXLEXEEG

SEQ ID NO: 246870 - protein, 15 aa, Artificial Sequence
  Description of Artificial Sequence: Synthetic peptide
  Seed: YPSLREAALLEEEEG (MAGA4_HUMAN)
  Core: REAALLEEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YPSLXEAXLXEEXEG

SEQ ID NO: 246871 - protein, 16 aa, Artificial Sequence
  Description of Artificial Sequence: Synthetic peptide
  Seed: YPSLREAALLEEEEGV (MAGA4_HUMAN)
  Core: LREAALLEE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YPSXREXAXLEXEEGV

SEQ ID NO: 246872 - protein, 16 aa, Artificial Sequence
  Description of Artificial Sequence: Synthetic peptide
  Seed: YPSLREAALLEEEEGV (MAGA4_HUMAN)
  Core: REAALLEEE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YPSLXEAXLXEEXEGV

SEQ ID NO: 246873 - protein, 16 aa, Artificial Sequence
  Description of Artificial Sequence: Synthetic peptide
  Seed: YPSLREAALLEEEEGV (MAGA4_HUMAN)
  Core: EAALLEEEE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YPSLRXAAXLXEEXGV

SEQ ID NO: 246874 - protein, 14 aa, Artificial Sequence
  Description of Artificial Sequence: Synthetic peptide
  Seed: YRAKELVTKAEMLE (MAGA4_HUMAN)
  Core: RAKELVTKA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
YXAKXLXTKXEMLE

SEQ ID NO: 246875 - protein, 14 aa, Artificial Sequence
  Description of Artificial Sequence: Synthetic peptide
  Seed: YRAKELVTKAEMLE (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLE

SEQ ID NO: 246876 - protein, 14 aa, Artificial Sequence
  Description of Artificial Sequence: Synthetic peptide
  Seed: YRAKELVTKAEMLE (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXE

SEQ ID NO: 246877 - protein, 15 aa, Artificial Sequence
  Description of Artificial Sequence: Synthetic peptide
  Seed: YRAKELVTKAEMLER (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLER

SEQ ID NO: 246878 - protein, 15 aa, Artificial Sequence
  Description of Artificial Sequence: Synthetic peptide
  Seed: YRAKELVTKAEMLER (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXER

SEQ ID NO: 246879 - protein, 15 aa, Artificial Sequence
  Description of Artificial Sequence: Synthetic peptide
  Seed: YRAKELVTKAEMLER (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXR

SEQ ID NO: 246880 - protein, 16 aa, Artificial Sequence
  Description of Artificial Sequence: Synthetic peptide
  Seed: YRAKELVTKAEMLERV (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERV

SEQ ID NO: 246881 - protein, 16 aa, Artificial Sequence
  Description of Artificial Sequence: Synthetic peptide
  Seed: YRAKELVTKAEMLERV (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERV

SEQ ID NO: 246882 - protein, 16 aa, Artificial Sequence
  Description of Artificial Sequence: Synthetic peptide
  Seed: YRAKELVTKAEMLERV (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRV

SEQ ID NO: 246883 - protein, 17 aa, Artificial Sequence
  Description of Artificial Sequence: Synthetic peptide
  Seed: YRAKELVTKAEMLERVI (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERVI

SEQ ID NO: 246884 - protein, 17 aa, Artificial Sequence
  Description of Artificial Sequence: Synthetic peptide
  Seed: YRAKELVTKAEMLERVI (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVI

SEQ ID NO: 246885 - protein, 17 aa, Artificial Sequence
  Description of Artificial Sequence: Synthetic peptide
  Seed: YRAKELVTKAEMLERVI (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVI

SEQ ID NO: 246886 - protein, 18 aa, Artificial Sequence
  Description of Artificial Sequence: Synthetic peptide
  Seed: YRAKELVTKAEMLERVIK (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERVIK

SEQ ID NO: 246887 - protein, 18 aa, Artificial Sequence
  Description of Artificial Sequence: Synthetic peptide
  Seed: YRAKELVTKAEMLERVIK (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIK

SEQ ID NO: 246888 - protein, 18 aa, Artificial Sequence
  Description of Artificial Sequence: Synthetic peptide
  Seed: YRAKELVTKAEMLERVIK (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIK

SEQ ID NO: 246889 - protein, 18 aa, Artificial Sequence
  Description of Artificial Sequence: Synthetic peptide
  Seed: YRAKELVTKAEMLERVIK (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIK

SEQ ID NO: 246890 - protein, 19 aa, Artificial Sequence
  Description of Artificial Sequence: Synthetic peptide
  Seed: YRAKELVTKAEMLERVIKN (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERVIKN

SEQ ID NO: 246891 - protein, 19 aa, Artificial Sequence
  Description of Artificial Sequence: Synthetic peptide
  Seed: YRAKELVTKAEMLERVIKN (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKN

SEQ ID NO: 246892 - protein, 19 aa, Artificial Sequence
  Description of Artificial Sequence: Synthetic peptide
  Seed: YRAKELVTKAEMLERVIKN (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKN

SEQ ID NO: 246893 - protein, 19 aa, Artificial Sequence
  Description of Artificial Sequence: Synthetic peptide
  Seed: YRAKELVTKAEMLERVIKN (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKN

SEQ ID NO: 246894 - protein, 19 aa, Artificial Sequence
  Description of Artificial Sequence: Synthetic peptide
  Seed: YRAKELVTKAEMLERVIKN (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKN

SEQ ID NO: 246895 - protein, 20 aa, Artificial Sequence
  Description of Artificial Sequence: Synthetic peptide
  Seed: YRAKELVTKAEMLERVIKNY (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERVIKNY

SEQ ID NO: 246896 - protein, 20 aa, Artificial Sequence
  Description of Artificial Sequence: Synthetic peptide
  Seed: YRAKELVTKAEMLERVIKNY (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNY

SEQ ID NO: 246897 - protein, 20 aa, Artificial Sequence
  Description of Artificial Sequence: Synthetic peptide
  Seed: YRAKELVTKAEMLERVIKNY (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNY

SEQ ID NO: 246898 - protein, 20 aa, Artificial Sequence
  Description of Artificial Sequence: Synthetic peptide
  Seed: YRAKELVTKAEMLERVIKNY (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNY

SEQ ID NO: 246899 - protein, 20 aa, Artificial Sequence
  Description of Artificial Sequence: Synthetic peptide
  Seed: YRAKELVTKAEMLERVIKNY (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNY

SEQ ID NO: 246900 - protein, 21 aa, Artificial Sequence
  Description of Artificial Sequence: Synthetic peptide
  Seed: YRAKELVTKAEMLERVIKNYK (MAGA4_HUMAN)
  Core: KELVTKAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRAXELXTXAEXLERVIKNYK

SEQ ID NO: 246901 - protein, 21 aa, Artificial Sequence
  Description of Artificial Sequence: Synthetic peptide
  Seed: YRAKELVTKAEMLERVIKNYK (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNYK

SEQ ID NO: 246902 - protein, 21 aa, Artificial Sequence
  Description of Artificial Sequence: Synthetic peptide
  Seed: YRAKELVTKAEMLERVIKNYK (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNYK

SEQ ID NO: 246903 - protein, 21 aa, Artificial Sequence
  Description of Artificial Sequence: Synthetic peptide
  Seed: YRAKELVTKAEMLERVIKNYK (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNYK

SEQ ID NO: 246904 - protein, 21 aa, Artificial Sequence
  Description of Artificial Sequence: Synthetic peptide
  Seed: YRAKELVTKAEMLERVIKNYK (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNYK

SEQ ID NO: 246905 - protein, 21 aa, Artificial Sequence
  Description of Artificial Sequence: Synthetic peptide
  Seed: YRAKELVTKAEMLERVIKNYK (MAGA4_HUMAN)
  Core: AEMLERVIK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKXEMXEXVIXNYK

SEQ ID NO: 246906 - protein, 21 aa, Artificial Sequence
  Description of Artificial Sequence: Synthetic peptide
  Seed: YRAKELVTKAEMLERVIKNYK (MAGA4_HUMAN)
  Core: EMLERVIKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAXMLXRXIKXYK

SEQ ID NO: 246907 - protein, 22 aa, Artificial Sequence
  Description of Artificial Sequence: Synthetic peptide
  Seed: YRAKELVTKAEMLERVIKNYKR (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNYKR

SEQ ID NO: 246908 - protein, 22 aa, Artificial Sequence
  Description of Artificial Sequence: Synthetic peptide
  Seed: YRAKELVTKAEMLERVIKNYKR (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNYKR

SEQ ID NO: 246909 - protein, 22 aa, Artificial Sequence
  Description of Artificial Sequence: Synthetic peptide
  Seed: YRAKELVTKAEMLERVIKNYKR (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNYKR

SEQ ID NO: 246910 - protein, 22 aa, Artificial Sequence
  Description of Artificial Sequence: Synthetic peptide
  Seed: YRAKELVTKAEMLERVIKNYKR (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNYKR

SEQ ID NO: 246911 - protein, 22 aa, Artificial Sequence
  Description of Artificial Sequence: Synthetic peptide
  Seed: YRAKELVTKAEMLERVIKNYKR (MAGA4_HUMAN)
  Core: EMLERVIKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAXMLXRXIKXYKR

SEQ ID NO: 246912 - protein, 22 aa, Artificial Sequence
  Description of Artificial Sequence: Synthetic peptide
  Seed: YRAKELVTKAEMLERVIKNYKR (MAGA4_HUMAN)
  Core: LERVIKNYK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMXERXIXNYXR

SEQ ID NO: 246913 - protein, 23 aa, Artificial Sequence
  Description of Artificial Sequence: Synthetic peptide
  Seed: YRAKELVTKAEMLERVIKNYKRC (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNYKRC

SEQ ID NO: 246914 - protein, 23 aa, Artificial Sequence
  Description of Artificial Sequence: Synthetic peptide
  Seed: YRAKELVTKAEMLERVIKNYKRC (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNYKRC

SEQ ID NO: 246915 - protein, 23 aa, Artificial Sequence
  Description of Artificial Sequence: Synthetic peptide
  Seed: YRAKELVTKAEMLERVIKNYKRC (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNYKRC

SEQ ID NO: 246916 - protein, 23 aa, Artificial Sequence
  Description of Artificial Sequence: Synthetic peptide
  Seed: YRAKELVTKAEMLERVIKNYKRC (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNYKRC

SEQ ID NO: 246917 - protein, 23 aa, Artificial Sequence
  Description of Artificial Sequence: Synthetic peptide
  Seed: YRAKELVTKAEMLERVIKNYKRC (MAGA4_HUMAN)
  Core: EMLERVIKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAXMLXRXIKXYKRC

SEQ ID NO: 246918 - protein, 23 aa, Artificial Sequence
  Description of Artificial Sequence: Synthetic peptide
  Seed: YRAKELVTKAEMLERVIKNYKRC (MAGA4_HUMAN)
  Core: LERVIKNYK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMXERXIXNYXRC

SEQ ID NO: 246919 - protein, 24 aa, Artificial Sequence
  Description of Artificial Sequence: Synthetic peptide
  Seed: YRAKELVTKAEMLERVIKNYKRCF (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNYKRCF

SEQ ID NO: 246920 - protein, 24 aa, Artificial Sequence
  Description of Artificial Sequence: Synthetic peptide
  Seed: YRAKELVTKAEMLERVIKNYKRCF (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNYKRCF

SEQ ID NO: 246921 - protein, 24 aa, Artificial Sequence
  Description of Artificial Sequence: Synthetic peptide
  Seed: YRAKELVTKAEMLERVIKNYKRCF (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNYKRCF

SEQ ID NO: 246922 - protein, 24 aa, Artificial Sequence
  Description of Artificial Sequence: Synthetic peptide
  Seed: YRAKELVTKAEMLERVIKNYKRCF (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNYKRCF

SEQ ID NO: 246923 - protein, 24 aa, Artificial Sequence
  Description of Artificial Sequence: Synthetic peptide
  Seed: YRAKELVTKAEMLERVIKNYKRCF (MAGA4_HUMAN)
  Core: EMLERVIKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAXMLXRXIKXYKRCF

SEQ ID NO: 246924 - protein, 24 aa, Artificial Sequence
  Description of Artificial Sequence: Synthetic peptide
  Seed: YRAKELVTKAEMLERVIKNYKRCF (MAGA4_HUMAN)
  Core: LERVIKNYK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMXERXIXNYXRCF

SEQ ID NO: 246925 - protein, 24 aa, Artificial Sequence
  Description of Artificial Sequence: Synthetic peptide
  Seed: YRAKELVTKAEMLERVIKNYKRCF (MAGA4_HUMAN)
  Core: RVIKNYKRC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMLEXVIXNXKRXF

SEQ ID NO: 246926 - protein, 25 aa, Artificial Sequence
  Description of Artificial Sequence: Synthetic peptide
  Seed: YRAKELVTKAEMLERVIKNYKRCFP (MAGA4_HUMAN)
  Core: ELVTKAEML
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YRAKXLVXKXEMXERVIKNYKRCFP

SEQ ID NO: 246927 - protein, 25 aa, Artificial Sequence
  Description of Artificial Sequence: Synthetic peptide
  Seed: YRAKELVTKAEMLERVIKNYKRCFP (MAGA4_HUMAN)
  Core: LVTKAEMLE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YRAKEXVTXAXMLXRVIKNYKRCFP

SEQ ID NO: 246928 - protein, 25 aa, Artificial Sequence
  Description of Artificial Sequence: Synthetic peptide
  Seed: YRAKELVTKAEMLERVIKNYKRCFP (MAGA4_HUMAN)
  Core: VTKAEMLER
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELXTKXEXLEXVIKNYKRCFP

SEQ ID NO: 246929 - protein, 25 aa, Artificial Sequence
  Description of Artificial Sequence: Synthetic peptide
  Seed: YRAKELVTKAEMLERVIKNYKRCFP (MAGA4_HUMAN)
  Core: TKAEMLERV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVXKAXMXERXIKNYKRCFP

SEQ ID NO: 246930 - protein, 25 aa, Artificial Sequence
  Description of Artificial Sequence: Synthetic peptide
  Seed: YRAKELVTKAEMLERVIKNYKRCFP (MAGA4_HUMAN)
  Core: EMLERVIKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAXMLXRXIKXYKRCFP

SEQ ID NO: 246931 - protein, 25 aa, Artificial Sequence
  Description of Artificial Sequence: Synthetic peptide
  Seed: YRAKELVTKAEMLERVIKNYKRCFP (MAGA4_HUMAN)
  Core: LERVIKNYK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMXERXIXNYXRCFP

SEQ ID NO: 246932 - protein, 25 aa, Artificial Sequence
  Description of Artificial Sequence: Synthetic peptide
  Seed: YRAKELVTKAEMLERVIKNYKRCFP (MAGA4_HUMAN)
  Core: ERVIKNYKR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMLXRVXKXYKXCFP

SEQ ID NO: 246933 - protein, 25 aa, Artificial Sequence
  Description of Artificial Sequence: Synthetic peptide
  Seed: YRAKELVTKAEMLERVIKNYKRCFP (MAGA4_HUMAN)
  Core: RVIKNYKRC
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YRAKELVTKAEMLEXVIXNXKRXFP

SEQ ID NO: 246934 - protein, 15 aa, Artificial Sequence
  Description of Artificial Sequence: Synthetic peptide
  Seed: YRQVPGSNPARYEFL (MAGA4_HUMAN)
  Core: VPGSNPARY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRQXPGXNXARXEFL

SEQ ID NO: 246935 - protein, 16 aa, Artificial Sequence
  Description of Artificial Sequence: Synthetic peptide
  Seed: YRQVPGSNPARYEFLW (MAGA4_HUMAN)
  Core: VPGSNPARY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRQXPGXNXARXEFLW

SEQ ID NO: 246936 - protein, 17 aa, Artificial Sequence
  Description of Artificial Sequence: Synthetic peptide
  Seed: YRQVPGSNPARYEFLWG (MAGA4_HUMAN)
  Core: VPGSNPARY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRQXPGXNXARXEFLWG

SEQ ID NO: 246937 - protein, 20 aa, Artificial Sequence
  Description of Artificial Sequence: Synthetic peptide
  Seed: YRQVPGSNPARYEFLWGPRA (MAGA4_HUMAN)
  Core: VPGSNPARY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRQXPGXNXARXEFLWGPRA

SEQ ID NO: 246938 - protein, 20 aa, Artificial Sequence
  Description of Artificial Sequence: Synthetic peptide
  Seed: YRQVPGSNPARYEFLWGPRA (MAGA4_HUMAN)
  Core: SNPARYEFL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGXNPXRXEFXWGPRA

SEQ ID NO: 246939 - protein, 20 aa, Artificial Sequence
  Description of Artificial Sequence: Synthetic peptide
  Seed: YRQVPGSNPARYEFLWGPRA (MAGA4_HUMAN)
  Core: PARYEFLWG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNXARXEXLWXPRA

SEQ ID NO: 246940 - protein, 20 aa, Artificial Sequence
  Description of Artificial Sequence: Synthetic peptide
  Seed: YRQVPGSNPARYEFLWGPRA (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRX

SEQ ID NO: 246941 - protein, 21 aa, Artificial Sequence
  Description of Artificial Sequence: Synthetic peptide
  Seed: YRQVPGSNPARYEFLWGPRAL (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRXL

SEQ ID NO: 246942 - protein, 22 aa, Artificial Sequence
  Description of Artificial Sequence: Synthetic peptide
  Seed: YRQVPGSNPARYEFLWGPRALA (MAGA4_HUMAN)
  Core: ARYEFLWGP
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPXRYXFXWGXRALA

SEQ ID NO: 246943 - protein, 22 aa, Artificial Sequence
  Description of Artificial Sequence: Synthetic peptide
  Seed: YRQVPGSNPARYEFLWGPRALA (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRXLA

SEQ ID NO: 246944 - protein, 23 aa, Artificial Sequence
  Description of Artificial Sequence: Synthetic peptide
  Seed: YRQVPGSNPARYEFLWGPRALAE (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRXLAE

SEQ ID NO: 246945 - protein, 23 aa, Artificial Sequence
  Description of Artificial Sequence: Synthetic peptide
  Seed: YRQVPGSNPARYEFLWGPRALAE (MAGA4_HUMAN)
  Core: FLWGPRALA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARYEXLWXPXALXE

SEQ ID NO: 246946 - protein, 24 aa, Artificial Sequence
  Description of Artificial Sequence: Synthetic peptide
  Seed: YRQVPGSNPARYEFLWGPRALAET (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRXLAET

SEQ ID NO: 246947 - protein, 24 aa, Artificial Sequence
  Description of Artificial Sequence: Synthetic peptide
  Seed: YRQVPGSNPARYEFLWGPRALAET (MAGA4_HUMAN)
  Core: FLWGPRALA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARYEXLWXPXALXET

SEQ ID NO: 246948 - protein, 25 aa, Artificial Sequence
  Description of Artificial Sequence: Synthetic peptide
  Seed: YRQVPGSNPARYEFLWGPRALAETS (MAGA4_HUMAN)
  Core: VPGSNPARY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YRQXPGXNXARXEFLWGPRALAETS

SEQ ID NO: 246949 - protein, 25 aa, Artificial Sequence
  Description of Artificial Sequence: Synthetic peptide
  Seed: YRQVPGSNPARYEFLWGPRALAETS (MAGA4_HUMAN)
  Core: YEFLWGPRA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARXEFXWXPRXLAETS

SEQ ID NO: 246950 - protein, 25 aa, Artificial Sequence
  Description of Artificial Sequence: Synthetic peptide
  Seed: YRQVPGSNPARYEFLWGPRALAETS (MAGA4_HUMAN)
  Core: FLWGPRALA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARYEXLWXPXALXETS

SEQ ID NO: 246951 - protein, 25 aa, Artificial Sequence
  Description of Artificial Sequence: Synthetic peptide
  Seed: YRQVPGSNPARYEFLWGPRALAETS (MAGA4_HUMAN)
  Core: LWGPRALAE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YRQVPGSNPARYEFXWGXRXLAXTS

SEQ ID NO: 246952 - protein, 14 aa, Artificial Sequence
  Description of Artificial Sequence: Synthetic peptide
  Seed: YTLVTCLGLSYDGL (MAGA4_HUMAN)
  Core: LVTCLGLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXVTXLXLSXDGL

SEQ ID NO: 246953 - protein, 14 aa, Artificial Sequence
  Description of Artificial Sequence: Synthetic peptide
  Seed: YTLVTCLGLSYDGL (MAGA4_HUMAN)
  Core: VTCLGLSYD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YTLXTCXGXSYXGL

SEQ ID NO: 246954 - protein, 15 aa, Artificial Sequence
  Description of Artificial Sequence: Synthetic peptide
  Seed: YTLVTCLGLSYDGLL (MAGA4_HUMAN)
  Core: LVTCLGLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXVTXLXLSXDGLL

SEQ ID NO: 246955 - protein, 15 aa, Artificial Sequence
  Description of Artificial Sequence: Synthetic peptide
  Seed: YTLVTCLGLSYDGLL (MAGA4_HUMAN)
  Core: VTCLGLSYD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YTLXTCXGXSYXGLL

SEQ ID NO: 246956 - protein, 15 aa, Artificial Sequence
  Description of Artificial Sequence: Synthetic peptide
  Seed: YTLVTCLGLSYDGLL (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLX

SEQ ID NO: 246957 - protein, 16 aa, Artificial Sequence
  Description of Artificial Sequence: Synthetic peptide
  Seed: YTLVTCLGLSYDGLLG (MAGA4_HUMAN)
  Core: LVTCLGLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXVTXLXLSXDGLLG

SEQ ID NO: 246958 - protein, 16 aa, Artificial Sequence
  Description of Artificial Sequence: Synthetic peptide
  Seed: YTLVTCLGLSYDGLLG (MAGA4_HUMAN)
  Core: VTCLGLSYD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YTLXTCXGXSYXGLLG

SEQ ID NO: 246959 - protein, 16 aa, Artificial Sequence
  Description of Artificial Sequence: Synthetic peptide
  Seed: YTLVTCLGLSYDGLLG (MAGA4_HUMAN)
  Core: CLGLSYDGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTXLGXSXDGXLG

SEQ ID NO: 246960 - protein, 16 aa, Artificial Sequence
  Description of Artificial Sequence: Synthetic peptide
  Seed: YTLVTCLGLSYDGLLG (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXG

SEQ ID NO: 246961 - protein, 17 aa, Artificial Sequence
  Description of Artificial Sequence: Synthetic peptide
  Seed: YTLVTCLGLSYDGLLGN (MAGA4_HUMAN)
  Core: LVTCLGLSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YTXVTXLXLSXDGLLGN

SEQ ID NO: 246962 - protein, 17 aa, Artificial Sequence
  Description of Artificial Sequence: Synthetic peptide
  Seed: YTLVTCLGLSYDGLLGN (MAGA4_HUMAN)
  Core: VTCLGLSYD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YTLXTCXGXSYXGLLGN

SEQ ID NO: 246963 - protein, 17 aa, Artificial Sequence
  Description of Artificial Sequence: Synthetic peptide
  Seed: YTLVTCLGLSYDGLLGN (MAGA4_HUMAN)
  Core: CLGLSYDGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTXLGXSXDGXLGN

SEQ ID NO: 246964 - protein, 17 aa, Artificial Sequence
  Description of Artificial Sequence: Synthetic peptide
  Seed: YTLVTCLGLSYDGLLGN (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGN

SEQ ID NO: 246965 - protein, 17 aa, Artificial Sequence
  Description of Artificial Sequence: Synthetic peptide
  Seed: YTLVTCLGLSYDGLLGN (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGX

SEQ ID NO: 246966 - protein, 18 aa, Artificial Sequence
  Description of Artificial Sequence: Synthetic peptide
  Seed: YTLVTCLGLSYDGLLGNN (MAGA4_HUMAN)
  Core: CLGLSYDGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTXLGXSXDGXLGNN

SEQ ID NO: 246967 - protein, 18 aa, Artificial Sequence
  Description of Artificial Sequence: Synthetic peptide
  Seed: YTLVTCLGLSYDGLLGNN (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNN

SEQ ID NO: 246968 - protein, 18 aa, Artificial Sequence
  Description of Artificial Sequence: Synthetic peptide
  Seed: YTLVTCLGLSYDGLLGNN (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXN

SEQ ID NO: 246969 - protein, 19 aa, Artificial Sequence
  Description of Artificial Sequence: Synthetic peptide
  Seed: YTLVTCLGLSYDGLLGNNQ (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQ

SEQ ID NO: 246970 - protein, 19 aa, Artificial Sequence
  Description of Artificial Sequence: Synthetic peptide
  Seed: YTLVTCLGLSYDGLLGNNQ (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQ

SEQ ID NO: 246971 - protein, 20 aa, Artificial Sequence
  Description of Artificial Sequence: Synthetic peptide
  Seed: YTLVTCLGLSYDGLLGNNQI (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQI

SEQ ID NO: 246972 - protein, 20 aa, Artificial Sequence
  Description of Artificial Sequence: Synthetic peptide
  Seed: YTLVTCLGLSYDGLLGNNQI (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQI

SEQ ID NO: 246973 - protein, 20 aa, Artificial Sequence
  Description of Artificial Sequence: Synthetic peptide
  Seed: YTLVTCLGLSYDGLLGNNQI (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXI

SEQ ID NO: 246974 - protein, 21 aa, Artificial Sequence
  Description of Artificial Sequence: Synthetic peptide
  Seed: YTLVTCLGLSYDGLLGNNQIF (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQIF

SEQ ID NO: 246975 - protein, 21 aa, Artificial Sequence
  Description of Artificial Sequence: Synthetic peptide
  Seed: YTLVTCLGLSYDGLLGNNQIF (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQIF

SEQ ID NO: 246976 - protein, 21 aa, Artificial Sequence
  Description of Artificial Sequence: Synthetic peptide
  Seed: YTLVTCLGLSYDGLLGNNQIF (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXIF

SEQ ID NO: 246977 - protein, 22 aa, Artificial Sequence
  Description of Artificial Sequence: Synthetic peptide
  Seed: YTLVTCLGLSYDGLLGNNQIFP (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQIFP

SEQ ID NO: 246978 - protein, 22 aa, Artificial Sequence
  Description of Artificial Sequence: Synthetic peptide
  Seed: YTLVTCLGLSYDGLLGNNQIFP (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQIFP

SEQ ID NO: 246979 - protein, 22 aa, Artificial Sequence
  Description of Artificial Sequence: Synthetic peptide
  Seed: YTLVTCLGLSYDGLLGNNQIFP (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXIFP

SEQ ID NO: 246980 - protein, 23 aa, Artificial Sequence
  Description of Artificial Sequence: Synthetic peptide
  Seed: YTLVTCLGLSYDGLLGNNQIFPK (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQIFPK

SEQ ID NO: 246981 - protein, 23 aa, Artificial Sequence
  Description of Artificial Sequence: Synthetic peptide
  Seed: YTLVTCLGLSYDGLLGNNQIFPK (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQIFPK

SEQ ID NO: 246982 - protein, 23 aa, Artificial Sequence
  Description of Artificial Sequence: Synthetic peptide
  Seed: YTLVTCLGLSYDGLLGNNQIFPK (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXIFPK

SEQ ID NO: 246983 - protein, 24 aa, Artificial Sequence
  Description of Artificial Sequence: Synthetic peptide
  Seed: YTLVTCLGLSYDGLLGNNQIFPKT (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQIFPKT

SEQ ID NO: 246984 - protein, 24 aa, Artificial Sequence
  Description of Artificial Sequence: Synthetic peptide
  Seed: YTLVTCLGLSYDGLLGNNQIFPKT (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQIFPKT

SEQ ID NO: 246985 - protein, 24 aa, Artificial Sequence
  Description of Artificial Sequence: Synthetic peptide
  Seed: YTLVTCLGLSYDGLLGNNQIFPKT (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXIFPKT

SEQ ID NO: 246986 - protein, 25 aa, Artificial Sequence
  Description of Artificial Sequence: Synthetic peptide
  Seed: YTLVTCLGLSYDGLLGNNQIFPKTG (MAGA4_HUMAN)
  Core: LGLSYDGLL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCXGLXYXGLXGNNQIFPKTG

SEQ ID NO: 246987 - protein, 25 aa, Artificial Sequence
  Description of Artificial Sequence: Synthetic peptide
  Seed: YTLVTCLGLSYDGLLGNNQIFPKTG (MAGA4_HUMAN)
  Core: LSYDGLLGN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGXSYXGXLGXNQIFPKTG

SEQ ID NO: 246988 - protein, 25 aa, Artificial Sequence
  Description of Artificial Sequence: Synthetic peptide
  Seed: YTLVTCLGLSYDGLLGNNQIFPKTG (MAGA4_HUMAN)
  Core: YDGLLGNNQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
YTLVTCLGLSXDGXLXNNXIFPKTG

SEQ ID NO: 246989 - protein, 13 aa, Artificial Sequence
  Description of Artificial Sequence: Synthetic peptide
  Seed: YVKVLEHVVRVNA (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNA

SEQ ID NO: 246990 - protein, 13 aa, Artificial Sequence
  Description of Artificial Sequence: Synthetic peptide
  Seed: YVKVLEHVVRVNA (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNX

SEQ ID NO: 246991 - protein, 14 aa, Artificial Sequence
  Description of Artificial Sequence: Synthetic peptide
  Seed: YVKVLEHVVRVNAR (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNAR

SEQ ID NO: 246992 - protein, 14 aa, Artificial Sequence
  Description of Artificial Sequence: Synthetic peptide
  Seed: YVKVLEHVVRVNAR (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXAR

SEQ ID NO: 246993 - protein, 14 aa, Artificial Sequence
  Description of Artificial Sequence: Synthetic peptide
  Seed: YVKVLEHVVRVNAR (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXR

SEQ ID NO: 246994 - protein, 15 aa, Artificial Sequence
  Description of Artificial Sequence: Synthetic peptide
  Seed: YVKVLEHVVRVNARV (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNARV

SEQ ID NO: 246995 - protein, 15 aa, Artificial Sequence
  Description of Artificial Sequence: Synthetic peptide
  Seed: YVKVLEHVVRVNARV (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARV

SEQ ID NO: 246996 - protein, 15 aa, Artificial Sequence
  Description of Artificial Sequence: Synthetic peptide
  Seed: YVKVLEHVVRVNARV (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRV

SEQ ID NO: 246997 - protein, 16 aa, Artificial Sequence
  Description of Artificial Sequence: Synthetic peptide
  Seed: YVKVLEHVVRVNARVR (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNARVR

SEQ ID NO: 246998 - protein, 16 aa, Artificial Sequence
  Description of Artificial Sequence: Synthetic peptide
  Seed: YVKVLEHVVRVNARVR (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVR

SEQ ID NO: 246999 - protein, 16 aa, Artificial Sequence
  Description of Artificial Sequence: Synthetic peptide
  Seed: YVKVLEHVVRVNARVR (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVR

SEQ ID NO: 247000 - protein, 17 aa, Artificial Sequence
  Description of Artificial Sequence: Synthetic peptide
  Seed: YVKVLEHVVRVNARVRI (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNARVRI

SEQ ID NO: 247001 - protein, 17 aa, Artificial Sequence
  Description of Artificial Sequence: Synthetic peptide
  Seed: YVKVLEHVVRVNARVRI (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRI

SEQ ID NO: 247002 - protein, 17 aa, Artificial Sequence
  Description of Artificial Sequence: Synthetic peptide
  Seed: YVKVLEHVVRVNARVRI (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRI

SEQ ID NO: 247003 - protein, 17 aa, Artificial Sequence
  Description of Artificial Sequence: Synthetic peptide
  Seed: YVKVLEHVVRVNARVRI (MAGA4_HUMAN)
  Core: EHVVRVNAR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLXHVXRXNAXVRI

SEQ ID NO: 247004 - protein, 17 aa, Artificial Sequence
  Description of Artificial Sequence: Synthetic peptide
  Seed: YVKVLEHVVRVNARVRI (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXI

SEQ ID NO: 247005 - protein, 17 aa, Artificial Sequence
  Description of Artificial Sequence: Synthetic peptide
  Seed: YVKVLEHVVRVNARVRI (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRX

SEQ ID NO: 247006 - protein, 18 aa, Artificial Sequence
  Description of Artificial Sequence: Synthetic peptide
  Seed: YVKVLEHVVRVNARVRIA (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNARVRIA

SEQ ID NO: 247007 - protein, 18 aa, Artificial Sequence
  Description of Artificial Sequence: Synthetic peptide
  Seed: YVKVLEHVVRVNARVRIA (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIA

SEQ ID NO: 247008 - protein, 18 aa, Artificial Sequence
  Description of Artificial Sequence: Synthetic peptide
  Seed: YVKVLEHVVRVNARVRIA (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIA

SEQ ID NO: 247009 - protein, 18 aa, Artificial Sequence
  Description of Artificial Sequence: Synthetic peptide
  Seed: YVKVLEHVVRVNARVRIA (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIA

SEQ ID NO: 247010 - protein, 18 aa, Artificial Sequence
  Description of Artificial Sequence: Synthetic peptide
  Seed: YVKVLEHVVRVNARVRIA (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXA

SEQ ID NO: 247011 - protein, 19 aa, Artificial Sequence
  Description of Artificial Sequence: Synthetic peptide
  Seed: YVKVLEHVVRVNARVRIAY (MAGA4_HUMAN)
  Core: KVLEHVVRV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
YVXVLXHXVRXNARVRIAY

SEQ ID NO: 247012 - protein, 19 aa, Artificial Sequence
  Description of Artificial Sequence: Synthetic peptide
  Seed: YVKVLEHVVRVNARVRIAY (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAY

SEQ ID NO: 247013 - protein, 19 aa, Artificial Sequence
  Description of Artificial Sequence: Synthetic peptide
  Seed: YVKVLEHVVRVNARVRIAY (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAY

SEQ ID NO: 247014 - protein, 19 aa, Artificial Sequence
  Description of Artificial Sequence: Synthetic peptide
  Seed: YVKVLEHVVRVNARVRIAY (MAGA4_HUMAN)
  Core: EHVVRVNAR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLXHVXRXNAXVRIAY

SEQ ID NO: 247015 - protein, 19 aa, Artificial Sequence
  Description of Artificial Sequence: Synthetic peptide
  Seed: YVKVLEHVVRVNARVRIAY (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAY

SEQ ID NO: 247016 - protein, 19 aa, Artificial Sequence
  Description of Artificial Sequence: Synthetic peptide
  Seed: YVKVLEHVVRVNARVRIAY (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAY

SEQ ID NO: 247017 - protein, 19 aa, Artificial Sequence
  Description of Artificial Sequence: Synthetic peptide
  Seed: YVKVLEHVVRVNARVRIAY (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXY

SEQ ID NO: 247018 - protein, 20 aa, Artificial Sequence
  Description of Artificial Sequence: Synthetic peptide
  Seed: YVKVLEHVVRVNARVRIAYP (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYP

SEQ ID NO: 247019 - protein, 20 aa, Artificial Sequence
  Description of Artificial Sequence: Synthetic peptide
  Seed: YVKVLEHVVRVNARVRIAYP (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYP

SEQ ID NO: 247020 - protein, 20 aa, Artificial Sequence
  Description of Artificial Sequence: Synthetic peptide
  Seed: YVKVLEHVVRVNARVRIAYP (MAGA4_HUMAN)
  Core: EHVVRVNAR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLXHVXRXNAXVRIAYP

SEQ ID NO: 247021 - protein, 20 aa, Artificial Sequence
  Description of Artificial Sequence: Synthetic peptide
  Seed: YVKVLEHVVRVNARVRIAYP (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYP

SEQ ID NO: 247022 - protein, 20 aa, Artificial Sequence
  Description of Artificial Sequence: Synthetic peptide
  Seed: YVKVLEHVVRVNARVRIAYP (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYP

SEQ ID NO: 247023 - protein, 20 aa, Artificial Sequence
  Description of Artificial Sequence: Synthetic peptide
  Seed: YVKVLEHVVRVNARVRIAYP (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYP

SEQ ID NO: 247024 - protein, 21 aa, Artificial Sequence
  Description of Artificial Sequence: Synthetic peptide
  Seed: YVKVLEHVVRVNARVRIAYPS (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYPS

SEQ ID NO: 247025 - protein, 21 aa, Artificial Sequence
  Description of Artificial Sequence: Synthetic peptide
  Seed: YVKVLEHVVRVNARVRIAYPS (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYPS

SEQ ID NO: 247026 - protein, 21 aa, Artificial Sequence
  Description of Artificial Sequence: Synthetic peptide
  Seed: YVKVLEHVVRVNARVRIAYPS (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYPS

SEQ ID NO: 247027 - protein, 21 aa, Artificial Sequence
  Description of Artificial Sequence: Synthetic peptide
  Seed: YVKVLEHVVRVNARVRIAYPS (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYPS

SEQ ID NO: 247028 - protein, 21 aa, Artificial Sequence
  Description of Artificial Sequence: Synthetic peptide
  Seed: YVKVLEHVVRVNARVRIAYPS (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYPS

SEQ ID NO: 247029 - protein, 22 aa, Artificial Sequence
  Description of Artificial Sequence: Synthetic peptide
  Seed: YVKVLEHVVRVNARVRIAYPSL (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYPSL

SEQ ID NO: 247030 - protein, 22 aa, Artificial Sequence
  Description of Artificial Sequence: Synthetic peptide
  Seed: YVKVLEHVVRVNARVRIAYPSL (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYPSL

SEQ ID NO: 247031 - protein, 22 aa, Artificial Sequence
  Description of Artificial Sequence: Synthetic peptide
  Seed: YVKVLEHVVRVNARVRIAYPSL (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYPSL

SEQ ID NO: 247032 - protein, 22 aa, Artificial Sequence
  Description of Artificial Sequence: Synthetic peptide
  Seed: YVKVLEHVVRVNARVRIAYPSL (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYPSL

SEQ ID NO: 247033 - protein, 22 aa, Artificial Sequence
  Description of Artificial Sequence: Synthetic peptide
  Seed: YVKVLEHVVRVNARVRIAYPSL (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYPSL

SEQ ID NO: 247034 - protein, 23 aa, Artificial Sequence
  Description of Artificial Sequence: Synthetic peptide
  Seed: YVKVLEHVVRVNARVRIAYPSLR (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYPSLR

SEQ ID NO: 247035 - protein, 23 aa, Artificial Sequence
  Description of Artificial Sequence: Synthetic peptide
  Seed: YVKVLEHVVRVNARVRIAYPSLR (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYPSLR

SEQ ID NO: 247036 - protein, 23 aa, Artificial Sequence
  Description of Artificial Sequence: Synthetic peptide
  Seed: YVKVLEHVVRVNARVRIAYPSLR (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYPSLR

SEQ ID NO: 247037 - protein, 23 aa, Artificial Sequence
  Description of Artificial Sequence: Synthetic peptide
  Seed: YVKVLEHVVRVNARVRIAYPSLR (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYPSLR

SEQ ID NO: 247038 - protein, 23 aa, Artificial Sequence
  Description of Artificial Sequence: Synthetic peptide
  Seed: YVKVLEHVVRVNARVRIAYPSLR (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYPSLR

SEQ ID NO: 247039 - protein, 23 aa, Artificial Sequence
  Description of Artificial Sequence: Synthetic peptide
  Seed: YVKVLEHVVRVNARVRIAYPSLR (MAGA4_HUMAN)
  Core: NARVRIAYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVXARXRXAYXSLR

SEQ ID NO: 247040 - protein, 23 aa, Artificial Sequence
  Description of Artificial Sequence: Synthetic peptide
  Seed: YVKVLEHVVRVNARVRIAYPSLR (MAGA4_HUMAN)
  Core: RVRIAYPSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNAXVRXAXPSXR

SEQ ID NO: 247041 - protein, 24 aa, Artificial Sequence
  Description of Artificial Sequence: Synthetic peptide
  Seed: YVKVLEHVVRVNARVRIAYPSLRE (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYPSLRE

SEQ ID NO: 247042 - protein, 24 aa, Artificial Sequence
  Description of Artificial Sequence: Synthetic peptide
  Seed: YVKVLEHVVRVNARVRIAYPSLRE (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYPSLRE

SEQ ID NO: 247043 - protein, 24 aa, Artificial Sequence
  Description of Artificial Sequence: Synthetic peptide
  Seed: YVKVLEHVVRVNARVRIAYPSLRE (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYPSLRE

SEQ ID NO: 247044 - protein, 24 aa, Artificial Sequence
  Description of Artificial Sequence: Synthetic peptide
  Seed: YVKVLEHVVRVNARVRIAYPSLRE (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYPSLRE

SEQ ID NO: 247045 - protein, 24 aa, Artificial Sequence
  Description of Artificial Sequence: Synthetic peptide
  Seed: YVKVLEHVVRVNARVRIAYPSLRE (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYPSLRE

SEQ ID NO: 247046 - protein, 24 aa, Artificial Sequence
  Description of Artificial Sequence: Synthetic peptide
  Seed: YVKVLEHVVRVNARVRIAYPSLRE (MAGA4_HUMAN)
  Core: NARVRIAYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVXARXRXAYXSLRE

SEQ ID NO: 247047 - protein, 24 aa, Artificial Sequence
  Description of Artificial Sequence: Synthetic peptide
  Seed: YVKVLEHVVRVNARVRIAYPSLRE (MAGA4_HUMAN)
  Core: ARVRIAYPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNXRVXIXYPXLRE

SEQ ID NO: 247048 - protein, 24 aa, Artificial Sequence
  Description of Artificial Sequence: Synthetic peptide
  Seed: YVKVLEHVVRVNARVRIAYPSLRE (MAGA4_HUMAN)
  Core: RVRIAYPSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNAXVRXAXPSXRE

SEQ ID NO: 247049 - protein, 25 aa, Artificial Sequence
  Description of Artificial Sequence: Synthetic peptide
  Seed: YVKVLEHVVRVNARVRIAYPSLREA (MAGA4_HUMAN)
  Core: VLEHVVRVN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
YVKXLEXVXRVXARVRIAYPSLREA

SEQ ID NO: 247050 - protein, 25 aa, Artificial Sequence
  Description of Artificial Sequence: Synthetic peptide
  Seed: YVKVLEHVVRVNARVRIAYPSLREA (MAGA4_HUMAN)
  Core: LEHVVRVNA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
YVKVXEHXVXVNXRVRIAYPSLREA

SEQ ID NO: 247051 - protein, 25 aa, Artificial Sequence
  Description of Artificial Sequence: Synthetic peptide
  Seed: YVKVLEHVVRVNARVRIAYPSLREA (MAGA4_HUMAN)
  Core: VVRVNARVR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHXVRXNXRVXIAYPSLREA

SEQ ID NO: 247052 - protein, 25 aa, Artificial Sequence
  Description of Artificial Sequence: Synthetic peptide
  Seed: YVKVLEHVVRVNARVRIAYPSLREA (MAGA4_HUMAN)
  Core: VRVNARVRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVXRVXAXVRXAYPSLREA

SEQ ID NO: 247053 - protein, 25 aa, Artificial Sequence
  Description of Artificial Sequence: Synthetic peptide
  Seed: YVKVLEHVVRVNARVRIAYPSLREA (MAGA4_HUMAN)
  Core: RVNARVRIA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVXVNXRXRIXYPSLREA

SEQ ID NO: 247054 - protein, 25 aa, Artificial Sequence
  Description of Artificial Sequence: Synthetic peptide
  Seed: YVKVLEHVVRVNARVRIAYPSLREA (MAGA4_HUMAN)
  Core: NARVRIAYP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVXARXRXAYXSLREA

SEQ ID NO: 247055 - protein, 25 aa, Artificial Sequence
  Description of Artificial Sequence: Synthetic peptide
  Seed: YVKVLEHVVRVNARVRIAYPSLREA (MAGA4_HUMAN)
  Core: ARVRIAYPS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNXRVXIXYPXLREA

SEQ ID NO: 247056 - protein, 25 aa, Artificial Sequence
  Description of Artificial Sequence: Synthetic peptide
  Seed: YVKVLEHVVRVNARVRIAYPSLREA (MAGA4_HUMAN)
  Core: RVRIAYPSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNAXVRXAXPSXREA

SEQ ID NO: 247057 - protein, 25 aa, Artificial Sequence
  Description of Artificial Sequence: Synthetic peptide
  Seed: YVKVLEHVVRVNARVRIAYPSLREA (MAGA4_HUMAN)
  Core: VRIAYPSLR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNARXRIXYXSLXEA

SEQ ID NO: 247058 - protein, 25 aa, Artificial Sequence
  Description of Artificial Sequence: Synthetic peptide
  Seed: YVKVLEHVVRVNARVRIAYPSLREA (MAGA4_HUMAN)
  Core: RIAYPSLRE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
YVKVLEHVVRVNARVXIAXPXLRXA

SEQ ID NO: 247059 - protein, 17 aa, Artificial Sequence
  Description of Artificial Sequence: Synthetic peptide
  Seed: IKRKVVEFLAMLKNTVP (MAGC1_HUMAN)
IKRKFVEFLPMLRNTVP

SEQ ID NO: 247060 - protein, 17 aa, Artificial Sequence
  Description of Artificial Sequence: Synthetic peptide
  Seed: IKRKVVEFLAMLKNTVP (MAGC1_HUMAN)
IKRKVFEFSAFLKVTVP

SEQ ID NO: 247061 - protein, 15 aa, Artificial Sequence
  Description of Artificial Sequence: Synthetic peptide
  Seed: SFFSYTLASLLQSSH (MAGC1_HUMAN)
SFFSFTLASPLQSSH

SEQ ID NO: 247062 - protein, 15 aa, Artificial Sequence
  Description of Artificial Sequence: Synthetic peptide
  Seed: SFFSYTLASLLQSSH (MAGC1_HUMAN)
SFFSYNLASLIQSSH

SEQ ID NO: 247063 - protein, 15 aa, Artificial Sequence
  Description of Artificial Sequence: Synthetic peptide
  Seed: SFFSYTLASLLQSSH (MAGC1_HUMAN)
SFRSYILASLLQSSH

SEQ ID NO: 247064 - protein, 25 aa, Homo sapiens
  Native (MAGC1_HUMAN)
AEMLTNVISRYTGYFPVIFRKAREF

SEQ ID NO: 247065 - protein, 15 aa, Homo sapiens
  Native (MAGC1_HUMAN)
EKVDELARFLLLKYQ

SEQ ID NO: 247066 - protein, 15 aa, Homo sapiens
  Native (MAGC1_HUMAN)
FPVIFRKAREFIEIL

SEQ ID NO: 247067 - protein, 15 aa, Homo sapiens
  Native (MAGC1_HUMAN)
KDMPTAGMPSLLQSS

SEQ ID NO: 247068 - protein, 15 aa, Homo sapiens
  Native (MAGC1_HUMAN)
LLLKYQVKQPITKAE

SEQ ID NO: 247069 - protein, 15 aa, Homo sapiens
  Native (MAGC1_HUMAN)
NTHSPLQIVPSLPEW

SEQ ID NO: 247070 - protein, 17 aa, Homo sapiens
  Native (MAGC1_HUMAN)
PASSFFSSALLSIFQSS

SEQ ID NO: 247071 - protein, 15 aa, Homo sapiens
  Native (MAGC1_HUMAN)
PDDSYVFVNTLDLTS

SEQ ID NO: 247072 - protein, 17 aa, Homo sapiens
  Native (MAGC1_HUMAN)
PMTSSFSSTLLSIFQSS

SEQ ID NO: 247073 - protein, 15 aa, Homo sapiens
  Native (MAGC1_HUMAN)
QGEDFQSSLQSPVSI

SEQ ID NO: 247074 - protein, 15 aa, Homo sapiens
  Native (MAGC1_HUMAN)
QGEEFQSSLQSPVSI

SEQ ID NO: 247075 - protein, 15 aa, Homo sapiens
  Native (MAGC1_HUMAN)
QIPVSAASSSTLVSI

SEQ ID NO: 247076 - protein, 20 aa, Homo sapiens
  Native (MAGC1_HUMAN)
QIPVSPSFSSTLVSLFQSSP

SEQ ID NO: 247077 - protein, 15 aa, Homo sapiens
  Native (MAGC1_HUMAN)
QIPVSRSFSSTLLSI

SEQ ID NO: 247078 - protein, 15 aa, Homo sapiens
  Native (MAGC1_HUMAN)
QIPVSSSFSYTLLSL

SEQ ID NO: 247079 - protein, 23 aa, Homo sapiens
  Native (MAGC1_HUMAN)
RKAREFIEILFGISLREVDPDDS

SEQ ID NO: 247080 - protein, 17 aa, Homo sapiens
  Native (MAGC1_HUMAN)
RPVSSFFSYTLASLLQS

SEQ ID NO: 247081 - protein, 15 aa, Homo sapiens
  Native (MAGC1_HUMAN)
RYEFLWGPRAHSEVI

SEQ ID NO: 247082 - protein, 15 aa, Homo sapiens
  Native (MAGC1_HUMAN)
SIIFIKGTYASEEVI

SEQ ID NO: 247083 - protein, 15 aa, Homo sapiens
  Native (MAGC1_HUMAN)
SPLYFPQSPLQGEEF

SEQ ID NO: 247084 - protein, 15 aa, Homo sapiens
  Native (MAGC1_HUMAN)
SPVISFSSSTSLSPF

SEQ ID NO: 247085 - protein, 15 aa, Homo sapiens
  Native (MAGC1_HUMAN)
SSTLLSLFQSSPERT

SEQ ID NO: 247086 - protein, 15 aa, Homo sapiens
  Native (MAGC1_HUMAN)
STLLSLFQSFSERTQ

SEQ ID NO: 247087 - protein, 25 aa, Homo sapiens
  Native (MAGC1_HUMAN)
TDSESLIESEPLFTYTLDEKVDELA

SEQ ID NO: 247088 - protein, 20 aa, Homo sapiens
  Native (MAGC1_HUMAN)
TKVWVQEHYLEYREVPNSSP

SEQ ID NO: 247089 - protein, 15 aa, Homo sapiens
  Native (MAGC1_HUMAN)
TSSFSSTLLSILQSS

SEQ ID NO: 247090 - protein, 15 aa, Homo sapiens
  Native (MAGC1_HUMAN)
VEFLAMLKNTVPITF

SEQ ID NO: 247091 - protein, 21 aa, Homo sapiens
  Native (MAGC1_HUMAN)
VKQPITKAEMLTNVISRYTGY

SEQ ID NO: 247092 - protein, 16 aa, Homo sapiens
  Native (MAGC1_HUMAN)
WDVLSGIGVRAGREHF

SEQ ID NO: 247093 - protein, 15 aa, Homo sapiens
  Native (MAGC1_HUMAN)
YTLLSLFQSSPERTH

SEQ ID NO: 247094 - protein, 13 aa, Homo sapiens
  Native (MAGC1_HUMAN)
AASSSTLVSIFQS

SEQ ID NO: 247095 - protein, 14 aa, Homo sapiens
  Native (MAGC1_HUMAN)
AASSSTLVSIFQSS

SEQ ID NO: 247096 - protein, 15 aa, Homo sapiens
  Native (MAGC1_HUMAN)
AASSSTLVSIFQSSP

SEQ ID NO: 247097 - protein, 16 aa, Homo sapiens
  Native (MAGC1_HUMAN)
AASSSTLVSIFQSSPE

SEQ ID NO: 247098 - protein, 17 aa, Homo sapiens
  Native (MAGC1_HUMAN)
AASSSTLVSIFQSSPES

SEQ ID NO: 247099 - protein, 18 aa, Homo sapiens
  Native (MAGC1_HUMAN)
AASSSTLVSIFQSSPEST

SEQ ID NO: 247100 - protein, 19 aa, Homo sapiens
  Native (MAGC1_HUMAN)
AASSSTLVSIFQSSPESTQ

SEQ ID NO: 247101 - protein, 20 aa, Homo sapiens
  Native (MAGC1_HUMAN)
AASSSTLVSIFQSSPESTQS

SEQ ID NO: 247102 - protein, 21 aa, Homo sapiens
  Native (MAGC1_HUMAN)
AASSSTLVSIFQSSPESTQSP

SEQ ID NO: 247103 - protein, 22 aa, Homo sapiens
  Native (MAGC1_HUMAN)
AASSSTLVSIFQSSPESTQSPF

SEQ ID NO: 247104 - protein, 23 aa, Homo sapiens
  Native (MAGC1_HUMAN)
AASSSTLVSIFQSSPESTQSPFE

SEQ ID NO: 247105 - protein, 24 aa, Homo sapiens
  Native (MAGC1_HUMAN)
AASSSTLVSIFQSSPESTQSPFEG

SEQ ID NO: 247106 - protein, 25 aa, Homo sapiens
  Native (MAGC1_HUMAN)
AASSSTLVSIFQSSPESTQSPFEGF

SEQ ID NO: 247107 - protein, 13 aa, Homo sapiens
  Native (MAGC1_HUMAN)
AEMLTNVISRYTG

SEQ ID NO: 247108 - protein, 14 aa, Homo sapiens
  Native (MAGC1_HUMAN)
AEMLTNVISRYTGY

SEQ ID NO: 247109 - protein, 15 aa, Homo sapiens
  Native (MAGC1_HUMAN)
AEMLTNVISRYTGYF

SEQ ID NO: 247110 - protein, 16 aa, Homo sapiens
  Native (MAGC1_HUMAN)
AEMLTNVISRYTGYFP

SEQ ID NO: 247111 - protein, 17 aa, Homo sapiens
  Native (MAGC1_HUMAN)
AEMLTNVISRYTGYFPV

SEQ ID NO: 247112 - protein, 18 aa, Homo sapiens
  Native (MAGC1_HUMAN)
AEMLTNVISRYTGYFPVI

SEQ ID NO: 247113 - protein, 19 aa, Homo sapiens
  Native (MAGC1_HUMAN)
AEMLTNVISRYTGYFPVIF

SEQ ID NO: 247114 - protein, 20 aa, Homo sapiens
  Native (MAGC1_HUMAN)
AEMLTNVISRYTGYFPVIFR

SEQ ID NO: 247115 - protein, 21 aa, Homo sapiens
  Native (MAGC1_HUMAN)
AEMLTNVISRYTGYFPVIFRK

SEQ ID NO: 247116 - protein, 22 aa, Homo sapiens
  Native (MAGC1_HUMAN)
AEMLTNVISRYTGYFPVIFRKA

SEQ ID NO: 247117 - protein, 23 aa, Homo sapiens
  Native (MAGC1_HUMAN)
AEMLTNVISRYTGYFPVIFRKAR

SEQ ID NO: 247118 - protein, 24 aa, Homo sapiens
  Native (MAGC1_HUMAN)
AEMLTNVISRYTGYFPVIFRKARE

SEQ ID NO: 247119 - protein, 15 aa, Homo sapiens
  Native (MAGC1_HUMAN)
AFEGFPQSPLQIPVS

SEQ ID NO: 247120 - protein, 16 aa, Homo sapiens
  Native (MAGC1_HUMAN)
AFEGFPQSPLQIPVSS

SEQ ID NO: 247121 - protein, 17 aa, Homo sapiens
  Native (MAGC1_HUMAN)
AFEGFPQSPLQIPVSSS

SEQ ID NO: 247122 - protein, 19 aa, Homo sapiens
  Native (MAGC1_HUMAN)
AFEGFPQSPLQIPVSSSFS

SEQ ID NO: 247123 - protein, 20 aa, Homo sapiens
  Native (MAGC1_HUMAN)
AFEGFPQSPLQIPVSSSFSY

SEQ ID NO: 247124 - protein, 21 aa, Homo sapiens
  Native (MAGC1_HUMAN)
AFEGFPQSPLQIPVSSSFSYT

SEQ ID NO: 247125 - protein, 22 aa, Homo sapiens
  Native (MAGC1_HUMAN)
AFEGFPQSPLQIPVSSSFSYTL

SEQ ID NO: 247126 - protein, 23 aa, Homo sapiens
  Native (MAGC1_HUMAN)
AFEGFPQSPLQIPVSSSFSYTLL

SEQ ID NO: 247127 - protein, 24 aa, Homo sapiens
  Native (MAGC1_HUMAN)
AFEGFPQSPLQIPVSSSFSYTLLS

SEQ ID NO: 247128 - protein, 25 aa, Homo sapiens
  Native (MAGC1_HUMAN)
AFEGFPQSPLQIPVSSSFSYTLLSL

SEQ ID NO: 247129 - protein, 16 aa, Homo sapiens
  Native (MAGC1_HUMAN)
AFGEPRELLTKVWVQE

SEQ ID NO: 247130 - protein, 17 aa, Homo sapiens
  Native (MAGC1_HUMAN)
AFGEPRELLTKVWVQEH

SEQ ID NO: 247131 - protein, 18 aa, Homo sapiens
  Native (MAGC1_HUMAN)
AFGEPRELLTKVWVQEHY

SEQ ID NO: 247132 - protein, 19 aa, Homo sapiens
  Native (MAGC1_HUMAN)
AFGEPRELLTKVWVQEHYL

SEQ ID NO: 247133 - protein, 20 aa, Homo sapiens
  Native (MAGC1_HUMAN)
AFGEPRELLTKVWVQEHYLE

SEQ ID NO: 247134 - protein, 21 aa, Homo sapiens
  Native (MAGC1_HUMAN)
AFGEPRELLTKVWVQEHYLEY

SEQ ID NO: 247135 - protein, 22 aa, Homo sapiens
  Native (MAGC1_HUMAN)
AFGEPRELLTKVWVQEHYLEYR

SEQ ID NO: 247136 - protein, 23 aa, Homo sapiens
  Native (MAGC1_HUMAN)
AFGEPRELLTKVWVQEHYLEYRE

SEQ ID NO: 247137 - protein, 24 aa, Homo sapiens
  Native (MAGC1_HUMAN)
AFGEPRELLTKVWVQEHYLEYREV

SEQ ID NO: 247138 - protein, 25 aa, Homo sapiens
  Native (MAGC1_HUMAN)
AFGEPRELLTKVWVQEHYLEYREVP

SEQ ID NO: 247139 - protein, 14 aa, Homo sapiens
  Native (MAGC1_HUMAN)
AGREHFAFGEPREL

SEQ ID NO: 247140 - protein, 15 aa, Homo sapiens
  Native (MAGC1_HUMAN)
AGREHFAFGEPRELL

SEQ ID NO: 247141 - protein, 16 aa, Homo sapiens
  Native (MAGC1_HUMAN)
AGREHFAFGEPRELLT

SEQ ID NO: 247142 - protein, 17 aa, Homo sapiens
  Native (MAGC1_HUMAN)
AGREHFAFGEPRELLTK

SEQ ID NO: 247143 - protein, 18 aa, Homo sapiens
  Native (MAGC1_HUMAN)
AGREHFAFGEPRELLTKV

SEQ ID NO: 247144 - protein, 19 aa, Homo sapiens
  Native (MAGC1_HUMAN)
AGREHFAFGEPRELLTKVW

SEQ ID NO: 247145 - protein, 20 aa, Homo sapiens
  Native (MAGC1_HUMAN)
AGREHFAFGEPRELLTKVWV

SEQ ID NO: 247146 - protein, 21 aa, Homo sapiens
  Native (MAGC1_HUMAN)
AGREHFAFGEPRELLTKVWVQ

SEQ ID NO: 247147 - protein, 22 aa, Homo sapiens
  Native (MAGC1_HUMAN)
AGREHFAFGEPRELLTKVWVQE

SEQ ID NO: 247148 - protein, 23 aa, Homo sapiens
  Native (MAGC1_HUMAN)
AGREHFAFGEPRELLTKVWVQEH

SEQ ID NO: 247149 - protein, 24 aa, Homo sapiens
  Native (MAGC1_HUMAN)
AGREHFAFGEPRELLTKVWVQEHY

SEQ ID NO: 247150 - protein, 25 aa, Homo sapiens
  Native (MAGC1_HUMAN)
AGREHFAFGEPRELLTKVWVQEHYL

SEQ ID NO: 247151 - protein, 15 aa, Homo sapiens
  Native (MAGC1_HUMAN)
AHSEVIKRKVVEFLA

SEQ ID NO: 247152 - protein, 16 aa, Homo sapiens
  Native (MAGC1_HUMAN)
AHSEVIKRKVVEFLAM

SEQ ID NO: 247153 - protein, 17 aa, Homo sapiens
  Native (MAGC1_HUMAN)
AHSEVIKRKVVEFLAML

SEQ ID NO: 247154 - protein, 18 aa, Homo sapiens
  Native (MAGC1_HUMAN)
AHSEVIKRKVVEFLAMLK

SEQ ID NO: 247155 - protein, 19 aa, Homo sapiens
  Native (MAGC1_HUMAN)
AHSEVIKRKVVEFLAMLKN

SEQ ID NO: 247156 - protein, 20 aa, Homo sapiens
  Native (MAGC1_HUMAN)
AHSEVIKRKVVEFLAMLKNT

SEQ ID NO: 247157 - protein, 21 aa, Homo sapiens
  Native (MAGC1_HUMAN)
AHSEVIKRKVVEFLAMLKNTV

SEQ ID NO: 247158 - protein, 22 aa, Homo sapiens
  Native (MAGC1_HUMAN)
AHSEVIKRKVVEFLAMLKNTVP

SEQ ID NO: 247159 - protein, 23 aa, Homo sapiens
  Native (MAGC1_HUMAN)
AHSEVIKRKVVEFLAMLKNTVPI

SEQ ID NO: 247160 - protein, 24 aa, Homo sapiens
  Native (MAGC1_HUMAN)
AHSEVIKRKVVEFLAMLKNTVPIT

SEQ ID NO: 247161 - protein, 25 aa, Homo sapiens
  Native (MAGC1_HUMAN)
AHSEVIKRKVVEFLAMLKNTVPITF

SEQ ID NO: 247162 - protein, 19 aa, Homo sapiens
  Native (MAGC1_HUMAN)
AIIDTTDDSTATESASSSV

SEQ ID NO: 247163 - protein, 20 aa, Homo sapiens
  Native (MAGC1_HUMAN)
AIIDTTDDSTATESASSSVM

SEQ ID NO: 247164 - protein, 21 aa, Homo sapiens
  Native (MAGC1_HUMAN)
AIIDTTDDSTATESASSSVMS

SEQ ID NO: 247165 - protein, 22 aa, Homo sapiens
  Native (MAGC1_HUMAN)
AIIDTTDDSTATESASSSVMSP

SEQ ID NO: 247166 - protein, 23 aa, Homo sapiens
  Native (MAGC1_HUMAN)
AIIDTTDDSTATESASSSVMSPS

SEQ ID NO: 247167 - protein, 24 aa, Homo sapiens
  Native (MAGC1_HUMAN)
AIIDTTDDSTATESASSSVMSPSF

SEQ ID NO: 247168 - protein, 25 aa, Homo sapiens
  Native (MAGC1_HUMAN)
AIIDTTDDSTATESASSSVMSPSFS

SEQ ID NO: 247169 - protein, 20 aa, Homo sapiens
  Native (MAGC1_HUMAN)
ALKDVEERAQAIIDTTDDST

SEQ ID NO: 247170 - protein, 23 aa, Homo sapiens
  Native (MAGC1_HUMAN)
ALKDVEERAQAIIDTTDDSTATE

SEQ ID NO: 247171 - protein, 24 aa, Homo sapiens
  Native (MAGC1_HUMAN)
ALKDVEERAQAIIDTTDDSTATES

SEQ ID NO: 247172 - protein, 25 aa, Homo sapiens
  Native (MAGC1_HUMAN)
ALKDVEERAQAIIDTTDDSTATESA

SEQ ID NO: 247173 - protein, 13 aa, Homo sapiens
  Native (MAGC1_HUMAN)
ALLSIFQSSPEST

SEQ ID NO: 247174 - protein, 14 aa, Homo sapiens
  Native (MAGC1_HUMAN)
ALLSIFQSSPESTQ

SEQ ID NO: 247175 - protein, 15 aa, Homo sapiens
  Native (MAGC1_HUMAN)
ALLSIFQSSPESTQS

SEQ ID NO: 247176 - protein, 16 aa, Homo sapiens
  Native (MAGC1_HUMAN)
ALLSIFQSSPESTQSP

SEQ ID NO: 247177 - protein, 17 aa, Homo sapiens
  Native (MAGC1_HUMAN)
ALLSIFQSSPESTQSPF

SEQ ID NO: 247178 - protein, 18 aa, Homo sapiens
  Native (MAGC1_HUMAN)
ALLSIFQSSPESTQSPFE

SEQ ID NO: 247179 - protein, 19 aa, Homo sapiens
  Native (MAGC1_HUMAN)
ALLSIFQSSPESTQSPFEG

SEQ ID NO: 247180 - protein, 20 aa, Homo sapiens
  Native (MAGC1_HUMAN)
ALLSIFQSSPESTQSPFEGF

SEQ ID NO: 247181 - protein, 21 aa, Homo sapiens
  Native (MAGC1_HUMAN)
ALLSIFQSSPESTQSPFEGFP

SEQ ID NO: 247182 - protein, 22 aa, Homo sapiens
  Native (MAGC1_HUMAN)
ALLSIFQSSPESTQSPFEGFPQ

SEQ ID NO: 247183 - protein, 23 aa, Homo sapiens
  Native (MAGC1_HUMAN)
ALLSIFQSSPESTQSPFEGFPQS

SEQ ID NO: 247184 - protein, 24 aa, Homo sapiens
  Native (MAGC1_HUMAN)
ALLSIFQSSPESTQSPFEGFPQSV

SEQ ID NO: 247185 - protein, 25 aa, Homo sapiens
  Native (MAGC1_HUMAN)
ALLSIFQSSPESTQSPFEGFPQSVL

SEQ ID NO: 247186 - protein, 13 aa, Homo sapiens
  Native (MAGC1_HUMAN)
AMLKNTVPITFPS

SEQ ID NO: 247187 - protein, 14 aa, Homo sapiens
  Native (MAGC1_HUMAN)
AMLKNTVPITFPSS

SEQ ID NO: 247188 - protein, 15 aa, Homo sapiens
  Native (MAGC1_HUMAN)
AMLKNTVPITFPSSY

SEQ ID NO: 247189 - protein, 16 aa, Homo sapiens
  Native (MAGC1_HUMAN)
AMLKNTVPITFPSSYK

SEQ ID NO: 247190 - protein, 17 aa, Homo sapiens
  Native (MAGC1_HUMAN)
AMLKNTVPITFPSSYKD

SEQ ID NO: 247191 - protein, 19 aa, Homo sapiens
  Native (MAGC1_HUMAN)
AMLKNTVPITFPSSYKDAL

SEQ ID NO: 247192 - protein, 20 aa, Homo sapiens
  Native (MAGC1_HUMAN)
AMLKNTVPITFPSSYKDALK

SEQ ID NO: 247193 - protein, 21 aa, Homo sapiens
  Native (MAGC1_HUMAN)
AMLKNTVPITFPSSYKDALKD

SEQ ID NO: 247194 - protein, 22 aa, Homo sapiens
  Native (MAGC1_HUMAN)
AMLKNTVPITFPSSYKDALKDV

SEQ ID NO: 247195 - protein, 23 aa, Homo sapiens
  Native (MAGC1_HUMAN)
AMLKNTVPITFPSSYKDALKDVE

SEQ ID NO: 247196 - protein, 24 aa, Homo sapiens
  Native (MAGC1_HUMAN)
AMLKNTVPITFPSSYKDALKDVEE

SEQ ID NO: 247197 - protein, 25 aa, Homo sapiens
  Native (MAGC1_HUMAN)
AMLKNTVPITFPSSYKDALKDVEER

SEQ ID NO: 247198 - protein, 20 aa, Homo sapiens
  Native (MAGC1_HUMAN)
APEGEDSLSPLQIPQSPLEG

SEQ ID NO: 247199 - protein, 21 aa, Homo sapiens
  Native (MAGC1_HUMAN)
APEGEDSLSPLQIPQSPLEGE

SEQ ID NO: 247200 - protein, 22 aa, Homo sapiens
  Native (MAGC1_HUMAN)
APEGEDSLSPLQIPQSPLEGED

SEQ ID NO: 247201 - protein, 23 aa, Homo sapiens
  Native (MAGC1_HUMAN)
APEGEDSLSPLQIPQSPLEGEDS

SEQ ID NO: 247202 - protein, 24 aa, Homo sapiens
  Native (MAGC1_HUMAN)
APEGEDSLSPLQIPQSPLEGEDSL

SEQ ID NO: 247203 - protein, 25 aa, Homo sapiens
  Native (MAGC1_HUMAN)
APEGEDSLSPLQIPQSPLEGEDSLS

SEQ ID NO: 247204 - protein, 20 aa, Homo sapiens
  Native (MAGC1_HUMAN)
AQAIIDTTDDSTATESASSS

SEQ ID NO: 247205 - protein, 21 aa, Homo sapiens
  Native (MAGC1_HUMAN)
AQAIIDTTDDSTATESASSSV

SEQ ID NO: 247206 - protein, 22 aa, Homo sapiens
  Native (MAGC1_HUMAN)
AQAIIDTTDDSTATESASSSVM

SEQ ID NO: 247207 - protein, 23 aa, Homo sapiens
  Native (MAGC1_HUMAN)
AQAIIDTTDDSTATESASSSVMS

SEQ ID NO: 247208 - protein, 24 aa, Homo sapiens
  Native (MAGC1_HUMAN)
AQAIIDTTDDSTATESASSSVMSP

SEQ ID NO: 247209 - protein, 25 aa, Homo sapiens
  Native (MAGC1_HUMAN)
AQAIIDTTDDSTATESASSSVMSPS

SEQ ID NO: 247210 - protein, 14 aa, Homo sapiens
  Native (MAGC1_HUMAN)
AQSAFEGFPQSPLQ

SEQ ID NO: 247211 - protein, 15 aa, Homo sapiens
  Native (MAGC1_HUMAN)
AQSAFEGFPQSPLQI

SEQ ID NO: 247212 - protein, 16 aa, Homo sapiens
  Native (MAGC1_HUMAN)
AQSAFEGFPQSPLQIP

SEQ ID NO: 247213 - protein, 17 aa, Homo sapiens
  Native (MAGC1_HUMAN)
AQSAFEGFPQSPLQIPV

SEQ ID NO: 247214 - protein, 19 aa, Homo sapiens
  Native (MAGC1_HUMAN)
AQSAFEGFPQSPLQIPVSS

SEQ ID NO: 247215 - protein, 20 aa, Homo sapiens
  Native (MAGC1_HUMAN)
AQSAFEGFPQSPLQIPVSSS

SEQ ID NO: 247216 - protein, 21 aa, Homo sapiens
  Native (MAGC1_HUMAN)
AQSAFEGFPQSPLQIPVSSSF

SEQ ID NO: 247217 - protein, 22 aa, Homo sapiens
  Native (MAGC1_HUMAN)
AQSAFEGFPQSPLQIPVSSSFS

SEQ ID NO: 247218 - protein, 23 aa, Homo sapiens
  Native (MAGC1_HUMAN)
AQSAFEGFPQSPLQIPVSSSFSY

SEQ ID NO: 247219 - protein, 24 aa, Homo sapiens
  Native (MAGC1_HUMAN)
AQSAFEGFPQSPLQIPVSSSFSYT

SEQ ID NO: 247220 - protein, 25 aa, Homo sapiens
  Native (MAGC1_HUMAN)
AQSAFEGFPQSPLQIPVSSSFSYTL

SEQ ID NO: 247221 - protein, 17 aa, Homo sapiens
  Native (MAGC1_HUMAN)
AQSPLQIPVSPSSSSTL

SEQ ID NO: 247222 - protein, 19 aa, Homo sapiens
  Native (MAGC1_HUMAN)
AQSPLQIPVSPSSSSTLLS

SEQ ID NO: 247223 - protein, 20 aa, Homo sapiens
  Native (MAGC1_HUMAN)
AQSPLQIPVSPSSSSTLLSL

SEQ ID NO: 247224 - protein, 21 aa, Homo sapiens
  Native (MAGC1_HUMAN)
AQSPLQIPVSPSSSSTLLSLF

SEQ ID NO: 247225 - protein, 22 aa, Homo sapiens
  Native (MAGC1_HUMAN)
AQSPLQIPVSPSSSSTLLSLFQ

SEQ ID NO: 247226 - protein, 23 aa, Homo sapiens
  Native (MAGC1_HUMAN)
AQSPLQIPVSPSSSSTLLSLFQS

SEQ ID NO: 247227 - protein, 24 aa, Homo sapiens
  Native (MAGC1_HUMAN)
AQSPLQIPVSPSSSSTLLSLFQSF

SEQ ID NO: 247228 - protein, 25 aa, Homo sapiens
  Native (MAGC1_HUMAN)
AQSPLQIPVSPSSSSTLLSLFQSFS

SEQ ID NO: 247229 - protein, 15 aa, Homo sapiens
  Native (MAGC1_HUMAN)
AQSPLQRPVSSFFSY

SEQ ID NO: 247230 - protein, 16 aa, Homo sapiens
  Native (MAGC1_HUMAN)
AQSPLQRPVSSFFSYT

SEQ ID NO: 247231 - protein, 17 aa, Homo sapiens
  Native (MAGC1_HUMAN)
AQSPLQRPVSSFFSYTL

SEQ ID NO: 247232 - protein, 18 aa, Homo sapiens
  Native (MAGC1_HUMAN)
AQSPLQRPVSSFFSYTLA

SEQ ID NO: 247233 - protein, 19 aa, Homo sapiens
  Native (MAGC1_HUMAN)
AQSPLQRPVSSFFSYTLAS

SEQ ID NO: 247234 - protein, 20 aa, Homo sapiens
  Native (MAGC1_HUMAN)
AQSPLQRPVSSFFSYTLASL

SEQ ID NO: 247235 - protein, 21 aa, Homo sapiens
  Native (MAGC1_HUMAN)
AQSPLQRPVSSFFSYTLASLL

SEQ ID NO: 247236 - protein, 22 aa, Homo sapiens
  Native (MAGC1_HUMAN)
AQSPLQRPVSSFFSYTLASLLQ

SEQ ID NO: 247237 - protein, 23 aa, Homo sapiens
  Native (MAGC1_HUMAN)
AQSPLQRPVSSFFSYTLASLLQS

SEQ ID NO: 247238 - protein, 24 aa, Homo sapiens
  Native (MAGC1_HUMAN)
AQSPLQRPVSSFFSYTLASLLQSS

SEQ ID NO: 247239 - protein, 25 aa, Homo sapiens
  Native (MAGC1_HUMAN)
AQSPLQRPVSSFFSYTLASLLQSSH

SEQ ID NO: 247240 - protein, 16 aa, Homo sapiens
  Native (MAGC1_HUMAN)
AQSPLQSPVSSFPSST

SEQ ID NO: 247241 - protein, 17 aa, Homo sapiens
  Native (MAGC1_HUMAN)
AQSPLQSPVSSFPSSTS

SEQ ID NO: 247242 - protein, 18 aa, Homo sapiens
  Native (MAGC1_HUMAN)
AQSPLQSPVSSFPSSTSS

SEQ ID NO: 247243 - protein, 19 aa, Homo sapiens
  Native (MAGC1_HUMAN)
AQSPLQSPVSSFPSSTSSS

SEQ ID NO: 247244 - protein, 20 aa, Homo sapiens
  Native (MAGC1_HUMAN)
AQSPLQSPVSSFPSSTSSSL

SEQ ID NO: 247245 - protein, 21 aa, Homo sapiens
  Native (MAGC1_HUMAN)
AQSPLQSPVSSFPSSTSSSLS

SEQ ID NO: 247246 - protein, 22 aa, Homo sapiens
  Native (MAGC1_HUMAN)
AQSPLQSPVSSFPSSTSSSLSQ

SEQ ID NO: 247247 - protein, 23 aa, Homo sapiens
  Native (MAGC1_HUMAN)
AQSPLQSPVSSFPSSTSSSLSQS

SEQ ID NO: 247248 - protein, 24 aa, Homo sapiens
  Native (MAGC1_HUMAN)
AQSPLQSPVSSFPSSTSSSLSQSS

SEQ ID NO: 247249 - protein, 25 aa, Homo sapiens
  Native (MAGC1_HUMAN)
AQSPLQSPVSSFPSSTSSSLSQSSP

SEQ ID NO: 247250 - protein, 15 aa, Homo sapiens
  Native (MAGC1_HUMAN)
AQSSLQIPVSPSFSS

SEQ ID NO: 247251 - protein, 16 aa, Homo sapiens
  Native (MAGC1_HUMAN)
AQSSLQIPVSPSFSST

SEQ ID NO: 247252 - protein, 17 aa, Homo sapiens
  Native (MAGC1_HUMAN)
AQSSLQIPVSPSFSSTL

SEQ ID NO: 247253 - protein, 19 aa, Homo sapiens
  Native (MAGC1_HUMAN)
AQSSLQIPVSPSFSSTLVS

SEQ ID NO: 247254 - protein, 20 aa, Homo sapiens
  Native (MAGC1_HUMAN)
AQSSLQIPVSPSFSSTLVSL

SEQ ID NO: 247255 - protein, 21 aa, Homo sapiens
  Native (MAGC1_HUMAN)
AQSSLQIPVSPSFSSTLVSLF

SEQ ID NO: 247256 - protein, 22 aa, Homo sapiens
  Native (MAGC1_HUMAN)
AQSSLQIPVSPSFSSTLVSLFQ

SEQ ID NO: 247257 - protein, 23 aa, Homo sapiens
  Native (MAGC1_HUMAN)
AQSSLQIPVSPSFSSTLVSLFQS

SEQ ID NO: 247258 - protein, 24 aa, Homo sapiens
  Native (MAGC1_HUMAN)
AQSSLQIPVSPSFSSTLVSLFQSS

SEQ ID NO: 247259 - protein, 25 aa, Homo sapiens
  Native (MAGC1_HUMAN)
AQSSLQIPVSPSFSSTLVSLFQSSP

SEQ ID NO: 247260 - protein, 15 aa, Homo sapiens
  Native (MAGC1_HUMAN)
AQSTFEGFPQSPLQI

SEQ ID NO: 247261 - protein, 16 aa, Homo sapiens
  Native (MAGC1_HUMAN)
AQSTFEGFPQSPLQIP

SEQ ID NO: 247262 - protein, 17 aa, Homo sapiens
  Native (MAGC1_HUMAN)
AQSTFEGFPQSPLQIPG

SEQ ID NO: 247263 - protein, 19 aa, Homo sapiens
  Native (MAGC1_HUMAN)
AQSTFEGFPQSPLQIPGSP

SEQ ID NO: 247264 - protein, 20 aa, Homo sapiens
  Native (MAGC1_HUMAN)
AQSTFEGFPQSPLQIPGSPS

SEQ ID NO: 247265 - protein, 21 aa, Homo sapiens
  Native (MAGC1_HUMAN)
AQSTFEGFPQSPLQIPGSPSF

SEQ ID NO: 247266 - protein, 22 aa, Homo sapiens
  Native (MAGC1_HUMAN)
AQSTFEGFPQSPLQIPGSPSFS

SEQ ID NO: 247267 - protein, 23 aa, Homo sapiens
  Native (MAGC1_HUMAN)
AQSTFEGFPQSPLQIPGSPSFSS

SEQ ID NO: 247268 - protein, 24 aa, Homo sapiens
  Native (MAGC1_HUMAN)
AQSTFEGFPQSPLQIPGSPSFSST

SEQ ID NO: 247269 - protein, 25 aa, Homo sapiens
  Native (MAGC1_HUMAN)
AQSTFEGFPQSPLQIPGSPSFSSTL

SEQ ID NO: 247270 - protein, 13 aa, Homo sapiens
  Native (MAGC1_HUMAN)
AREFIEILFGISL

SEQ ID NO: 247271 - protein, 14 aa, Homo sapiens
  Native (MAGC1_HUMAN)
AREFIEILFGISLR

SEQ ID NO: 247272 - protein, 15 aa, Homo sapiens
  Native (MAGC1_HUMAN)
AREFIEILFGISLRE

SEQ ID NO: 247273 - protein, 16 aa, Homo sapiens
  Native (MAGC1_HUMAN)
AREFIEILFGISLREV

SEQ ID NO: 247274 - protein, 17 aa, Homo sapiens
  Native (MAGC1_HUMAN)
AREFIEILFGISLREVD

SEQ ID NO: 247275 - protein, 18 aa, Homo sapiens
  Native (MAGC1_HUMAN)
AREFIEILFGISLREVDP

SEQ ID NO: 247276 - protein, 19 aa, Homo sapiens
  Native (MAGC1_HUMAN)
AREFIEILFGISLREVDPD

SEQ ID NO: 247277 - protein, 20 aa, Homo sapiens
  Native (MAGC1_HUMAN)
AREFIEILFGISLREVDPDD

SEQ ID NO: 247278 - protein, 21 aa, Homo sapiens
  Native (MAGC1_HUMAN)
AREFIEILFGISLREVDPDDS

SEQ ID NO: 247279 - protein, 22 aa, Homo sapiens
  Native (MAGC1_HUMAN)
AREFIEILFGISLREVDPDDSY

SEQ ID NO: 247280 - protein, 23 aa, Homo sapiens
  Native (MAGC1_HUMAN)
AREFIEILFGISLREVDPDDSYV

SEQ ID NO: 247281 - protein, 24 aa, Homo sapiens
  Native (MAGC1_HUMAN)
AREFIEILFGISLREVDPDDSYVF

SEQ ID NO: 247282 - protein, 25 aa, Homo sapiens
  Native (MAGC1_HUMAN)
AREFIEILFGISLREVDPDDSYVFV

SEQ ID NO: 247283 - protein, 13 aa, Homo sapiens
  Native (MAGC1_HUMAN)
ARFLLLKYQVKQP

SEQ ID NO: 247284 - protein, 14 aa, Homo sapiens
  Native (MAGC1_HUMAN)
ARFLLLKYQVKQPI

SEQ ID NO: 247285 - protein, 15 aa, Homo sapiens
  Native (MAGC1_HUMAN)
ARFLLLKYQVKQPIT

SEQ ID NO: 247286 - protein, 16 aa, Homo sapiens
  Native (MAGC1_HUMAN)
ARFLLLKYQVKQPITK

SEQ ID NO: 247287 - protein, 17 aa, Homo sapiens
  Native (MAGC1_HUMAN)
ARFLLLKYQVKQPITKA

SEQ ID NO: 247288 - protein, 18 aa, Homo sapiens
  Native (MAGC1_HUMAN)
ARFLLLKYQVKQPITKAE

SEQ ID NO: 247289 - protein, 19 aa, Homo sapiens
  Native (MAGC1_HUMAN)
ARFLLLKYQVKQPITKAEM

SEQ ID NO: 247290 - protein, 20 aa, Homo sapiens
  Native (MAGC1_HUMAN)
ARFLLLKYQVKQPITKAEML

SEQ ID NO: 247291 - protein, 21 aa, Homo sapiens
  Native (MAGC1_HUMAN)
ARFLLLKYQVKQPITKAEMLT

SEQ ID NO: 247292 - protein, 22 aa, Homo sapiens
  Native (MAGC1_HUMAN)
ARFLLLKYQVKQPITKAEMLTN

SEQ ID NO: 247293 - protein, 23 aa, Homo sapiens
  Native (MAGC1_HUMAN)
ARFLLLKYQVKQPITKAEMLTNV

SEQ ID NO: 247294 - protein, 24 aa, Homo sapiens
  Native (MAGC1_HUMAN)
ARFLLLKYQVKQPITKAEMLTNVI

SEQ ID NO: 247295 - protein, 25 aa, Homo sapiens
  Native (MAGC1_HUMAN)
ARFLLLKYQVKQPITKAEMLTNVIS

SEQ ID NO: 247296 - protein, 13 aa, Homo sapiens
  Native (MAGC1_HUMAN)
ASEEVIWDVLSGI

SEQ ID NO: 247297 - protein, 14 aa, Homo sapiens
  Native (MAGC1_HUMAN)
ASEEVIWDVLSGIG

SEQ ID NO: 247298 - protein, 15 aa, Homo sapiens
  Native (MAGC1_HUMAN)
ASEEVIWDVLSGIGV

SEQ ID NO: 247299 - protein, 16 aa, Homo sapiens
  Native (MAGC1_HUMAN)
ASEEVIWDVLSGIGVR

SEQ ID NO: 247300 - protein, 17 aa, Homo sapiens
  Native (MAGC1_HUMAN)
ASEEVIWDVLSGIGVRA

SEQ ID NO: 247301 - protein, 18 aa, Homo sapiens
  Native (MAGC1_HUMAN)
ASEEVIWDVLSGIGVRAG

SEQ ID NO: 247302 - protein, 19 aa, Homo sapiens
  Native (MAGC1_HUMAN)
ASEEVIWDVLSGIGVRAGR

SEQ ID NO: 247303 - protein, 20 aa, Homo sapiens
  Native (MAGC1_HUMAN)
ASEEVIWDVLSGIGVRAGRE

SEQ ID NO: 247304 - protein, 21 aa, Homo sapiens
  Native (MAGC1_HUMAN)
ASEEVIWDVLSGIGVRAGREH

SEQ ID NO: 247305 - protein, 22 aa, Homo sapiens
  Native (MAGC1_HUMAN)
ASEEVIWDVLSGIGVRAGREHF

SEQ ID NO: 247306 - protein, 23 aa, Homo sapiens
  Native (MAGC1_HUMAN)
ASEEVIWDVLSGIGVRAGREHFA

SEQ ID NO: 247307 - protein, 24 aa, Homo sapiens
  Native (MAGC1_HUMAN)
ASEEVIWDVLSGIGVRAGREHFAF

SEQ ID NO: 247308 - protein, 25 aa, Homo sapiens
  Native (MAGC1_HUMAN)
ASEEVIWDVLSGIGVRAGREHFAFG

SEQ ID NO: 247309 - protein, 13 aa, Homo sapiens
  Native (MAGC1_HUMAN)
ASSFFSSALLSIF

SEQ ID NO: 247310 - protein, 14 aa, Homo sapiens
  Native (MAGC1_HUMAN)
ASSFFSSALLSIFQ

SEQ ID NO: 247311 - protein, 15 aa, Homo sapiens
  Native (MAGC1_HUMAN)
ASSFFSSALLSIFQS

SEQ ID NO: 247312 - protein, 16 aa, Homo sapiens
  Native (MAGC1_HUMAN)
ASSFFSSALLSIFQSS

SEQ ID NO: 247313 - protein, 17 aa, Homo sapiens
  Native (MAGC1_HUMAN)
ASSFFSSALLSIFQSSP

SEQ ID NO: 247314 - protein, 18 aa, Homo sapiens
  Native (MAGC1_HUMAN)
ASSFFSSALLSIFQSSPE

SEQ ID NO: 247315 - protein, 19 aa, Homo sapiens
  Native (MAGC1_HUMAN)
ASSFFSSALLSIFQSSPES

SEQ ID NO: 247316 - protein, 20 aa, Homo sapiens
  Native (MAGC1_HUMAN)
ASSFFSSALLSIFQSSPEST

SEQ ID NO: 247317 - protein, 21 aa, Homo sapiens
  Native (MAGC1_HUMAN)
ASSFFSSALLSIFQSSPESTQ

SEQ ID NO: 247318 - protein, 22 aa, Homo sapiens
  Native (MAGC1_HUMAN)
ASSFFSSALLSIFQSSPESTQS

SEQ ID NO: 247319 - protein, 23 aa, Homo sapiens
  Native (MAGC1_HUMAN)
ASSFFSSALLSIFQSSPESTQSP

SEQ ID NO: 247320 - protein, 24 aa, Homo sapiens
  Native (MAGC1_HUMAN)
ASSFFSSALLSIFQSSPESTQSPF

SEQ ID NO: 247321 - protein, 25 aa, Homo sapiens
  Native (MAGC1_HUMAN)
ASSFFSSALLSIFQSSPESTQSPFE

SEQ ID NO: 247322 - protein, 13 aa, Homo sapiens
  Native (MAGC1_HUMAN)
ASSSTLVSIFQSS

SEQ ID NO: 247323 - protein, 14 aa, Homo sapiens
  Native (MAGC1_HUMAN)
ASSSTLVSIFQSSP

SEQ ID NO: 247324 - protein, 15 aa, Homo sapiens
  Native (MAGC1_HUMAN)
ASSSTLVSIFQSSPE

SEQ ID NO: 247325 - protein, 16 aa, Homo sapiens
  Native (MAGC1_HUMAN)
ASSSTLVSIFQSSPES

SEQ ID NO: 247326 - protein, 17 aa, Homo sapiens
  Native (MAGC1_HUMAN)
ASSSTLVSIFQSSPEST

SEQ ID NO: 247327 - protein, 18 aa, Homo sapiens
  Native (MAGC1_HUMAN)
ASSSTLVSIFQSSPESTQ

SEQ ID NO: 247328 - protein, 19 aa, Homo sapiens
  Native (MAGC1_HUMAN)
ASSSTLVSIFQSSPESTQS

SEQ ID NO: 247329 - protein, 20 aa, Homo sapiens
  Native (MAGC1_HUMAN)
ASSSTLVSIFQSSPESTQSP

SEQ ID NO: 247330 - protein, 21 aa, Homo sapiens
  Native (MAGC1_HUMAN)
ASSSTLVSIFQSSPESTQSPF

SEQ ID NO: 247331 - protein, 22 aa, Homo sapiens
  Native (MAGC1_HUMAN)
ASSSTLVSIFQSSPESTQSPFE

SEQ ID NO: 247332 - protein, 23 aa, Homo sapiens
  Native (MAGC1_HUMAN)
ASSSTLVSIFQSSPESTQSPFEG

SEQ ID NO: 247333 - protein, 24 aa, Homo sapiens
  Native (MAGC1_HUMAN)
ASSSTLVSIFQSSPESTQSPFEGF

SEQ ID NO: 247334 - protein, 25 aa, Homo sapiens
  Native (MAGC1_HUMAN)
ASSSTLVSIFQSSPESTQSPFEGFP

SEQ ID NO: 247335 - protein, 13 aa, Homo sapiens
  Native (MAGC1_HUMAN)
ASSSVMSPSFSSE

SEQ ID NO: 247336 - protein, 13 aa, Homo sapiens
  Native (MAGC1_HUMAN)
ATESASSSVMSPS

SEQ ID NO: 247337 - protein, 14 aa, Homo sapiens
  Native (MAGC1_HUMAN)
ATESASSSVMSPSF

SEQ ID NO: 247338 - protein, 15 aa, Homo sapiens
  Native (MAGC1_HUMAN)
ATESASSSVMSPSFS

SEQ ID NO: 247339 - protein, 16 aa, Homo sapiens
  Native (MAGC1_HUMAN)
ATESASSSVMSPSFSS

SEQ ID NO: 247340 - protein, 17 aa, Homo sapiens
  Native (MAGC1_HUMAN)
ATESASSSVMSPSFSSE

SEQ ID NO: 247341 - protein, 16 aa, Homo sapiens
  Native (MAGC1_HUMAN)
CLSDEQGMSQNRLLIL

SEQ ID NO: 247342 - protein, 17 aa, Homo sapiens
  Native (MAGC1_HUMAN)
CLSDEQGMSQNRLLILI

SEQ ID NO: 247343 - protein, 18 aa, Homo sapiens
  Native (MAGC1_HUMAN)
CLSDEQGMSQNRLLILIL

SEQ ID NO: 247344 - protein, 19 aa, Homo sapiens
  Native (MAGC1_HUMAN)
CLSDEQGMSQNRLLILILS

SEQ ID NO: 247345 - protein, 20 aa, Homo sapiens
  Native (MAGC1_HUMAN)
CLSDEQGMSQNRLLILILSI

SEQ ID NO: 247346 - protein, 21 aa, Homo sapiens
  Native (MAGC1_HUMAN)
CLSDEQGMSQNRLLILILSII

SEQ ID NO: 247347 - protein, 22 aa, Homo sapiens
  Native (MAGC1_HUMAN)
CLSDEQGMSQNRLLILILSIIF

SEQ ID NO: 247348 - protein, 23 aa, Homo sapiens
  Native (MAGC1_HUMAN)
CLSDEQGMSQNRLLILILSIIFI

SEQ ID NO: 247349 - protein, 24 aa, Homo sapiens
  Native (MAGC1_HUMAN)
CLSDEQGMSQNRLLILILSIIFIK

SEQ ID NO: 247350 - protein, 25 aa, Homo sapiens
  Native (MAGC1_HUMAN)
CLSDEQGMSQNRLLILILSIIFIKG

SEQ ID NO: 247351 - protein, 15 aa, Homo sapiens
  Native (MAGC1_HUMAN)
CSSSTPSSLPQSFPE

SEQ ID NO: 247352 - protein, 14 aa, Homo sapiens
  Native (MAGC1_HUMAN)
CSSSTSLSLPQSFP

SEQ ID NO: 247353 - protein, 15 aa, Homo sapiens
  Native (MAGC1_HUMAN)
CSSSTSLSLPQSFPE

SEQ ID NO: 247354 - protein, 16 aa, Homo sapiens
  Native (MAGC1_HUMAN)
CSSSTSLSLPQSFPES

SEQ ID NO: 247355 - protein, 17 aa, Homo sapiens
  Native (MAGC1_HUMAN)
CSSSTSLSLPQSFPESP

SEQ ID NO: 247356 - protein, 20 aa, Homo sapiens
  Native (MAGC1_HUMAN)
CSSSTSLSLPQSFPESPQSP

SEQ ID NO: 247357 - protein, 14 aa, Homo sapiens
  Native (MAGC1_HUMAN)
CTQSTFEGFPQSPL

SEQ ID NO: 247358 - protein, 15 aa, Homo sapiens
  Native (MAGC1_HUMAN)
CTQSTFEGFPQSPLQ

SEQ ID NO: 247359 - protein, 16 aa, Homo sapiens
  Native (MAGC1_HUMAN)
CTQSTFEGFPQSPLQI

SEQ ID NO: 247360 - protein, 17 aa, Homo sapiens
  Native (MAGC1_HUMAN)
CTQSTFEGFPQSPLQIP

SEQ ID NO: 247361 - protein, 19 aa, Homo sapiens
  Native (MAGC1_HUMAN)
CTQSTFEGFPQSPLQIPQS

SEQ ID NO: 247362 - protein, 20 aa, Homo sapiens
  Native (MAGC1_HUMAN)
CTQSTFEGFPQSPLQIPQSP

SEQ ID NO: 247363 - protein, 21 aa, Homo sapiens
  Native (MAGC1_HUMAN)
CTQSTFEGFPQSPLQIPQSPP

SEQ ID NO: 247364 - protein, 22 aa, Homo sapiens
  Native (MAGC1_HUMAN)
CTQSTFEGFPQSPLQIPQSPPE

SEQ ID NO: 247365 - protein, 23 aa, Homo sapiens
  Native (MAGC1_HUMAN)
CTQSTFEGFPQSPLQIPQSPPEG

SEQ ID NO: 247366 - protein, 24 aa, Homo sapiens
  Native (MAGC1_HUMAN)
CTQSTFEGFPQSPLQIPQSPPEGE

SEQ ID NO: 247367 - protein, 25 aa, Homo sapiens
  Native (MAGC1_HUMAN)
CTQSTFEGFPQSPLQIPQSPPEGEN

SEQ ID NO: 247368 - protein, 24 aa, Homo sapiens
  Native (MAGC1_HUMAN)
DALKDVEERAQAIIDTTDDSTATE

SEQ ID NO: 247369 - protein, 25 aa, Homo sapiens
  Native (MAGC1_HUMAN)
DALKDVEERAQAIIDTTDDSTATES

SEQ ID NO: 247370 - protein, 14 aa, Homo sapiens
  Native (MAGC1_HUMAN)
DDSTATESASSSVM

SEQ ID NO: 247371 - protein, 15 aa, Homo sapiens
  Native (MAGC1_HUMAN)
DDSTATESASSSVMS

SEQ ID NO: 247372 - protein, 16 aa, Homo sapiens
  Native (MAGC1_HUMAN)
DDSTATESASSSVMSP

SEQ ID NO: 247373 - protein, 17 aa, Homo sapiens
  Native (MAGC1_HUMAN)
DDSTATESASSSVMSPS

SEQ ID NO: 247374 - protein, 18 aa, Homo sapiens
  Native (MAGC1_HUMAN)
DDSTATESASSSVMSPSF

SEQ ID NO: 247375 - protein, 19 aa, Homo sapiens
  Native (MAGC1_HUMAN)
DDSTATESASSSVMSPSFS

SEQ ID NO: 247376 - protein, 20 aa, Homo sapiens
  Native (MAGC1_HUMAN)
DDSTATESASSSVMSPSFSS

SEQ ID NO: 247377 - protein, 21 aa, Homo sapiens
  Native (MAGC1_HUMAN)
DDSTATESASSSVMSPSFSSE

SEQ ID NO: 247378 - protein, 13 aa, Homo sapiens
  Native (MAGC1_HUMAN)
DDSYVFVNTLDLT

SEQ ID NO: 247379 - protein, 14 aa, Homo sapiens
  Native (MAGC1_HUMAN)
DDSYVFVNTLDLTS

SEQ ID NO: 247380 - protein, 15 aa, Homo sapiens
  Native (MAGC1_HUMAN)
DDSYVFVNTLDLTSE

SEQ ID NO: 247381 - protein, 16 aa, Homo sapiens
  Native (MAGC1_HUMAN)
DDSYVFVNTLDLTSEG

SEQ ID NO: 247382 - protein, 17 aa, Homo sapiens
  Native (MAGC1_HUMAN)
DDSYVFVNTLDLTSEGC

SEQ ID NO: 247383 - protein, 18 aa, Homo sapiens
  Native (MAGC1_HUMAN)
DDSYVFVNTLDLTSEGCL

SEQ ID NO: 247384 - protein, 19 aa, Homo sapiens
  Native (MAGC1_HUMAN)
DDSYVFVNTLDLTSEGCLS

SEQ ID NO: 247385 - protein, 20 aa, Homo sapiens
  Native (MAGC1_HUMAN)
DDSYVFVNTLDLTSEGCLSD

SEQ ID NO: 247386 - protein, 21 aa, Homo sapiens
  Native (MAGC1_HUMAN)
DDSYVFVNTLDLTSEGCLSDE

SEQ ID NO: 247387 - protein, 22 aa, Homo sapiens
  Native (MAGC1_HUMAN)
DDSYVFVNTLDLTSEGCLSDEQ

SEQ ID NO: 247388 - protein, 23 aa, Homo sapiens
  Native (MAGC1_HUMAN)
DDSYVFVNTLDLTSEGCLSDEQG

SEQ ID NO: 247389 - protein, 24 aa, Homo sapiens
  Native (MAGC1_HUMAN)
DDSYVFVNTLDLTSEGCLSDEQGM

SEQ ID NO: 247390 - protein, 25 aa, Homo sapiens
  Native (MAGC1_HUMAN)
DDSYVFVNTLDLTSEGCLSDEQGMS

SEQ ID NO: 247391 - protein, 14 aa, Homo sapiens
  Native (MAGC1_HUMAN)
DDTLYPLQSPQSRS

SEQ ID NO: 247392 - protein, 15 aa, Homo sapiens
  Native (MAGC1_HUMAN)
DDTLYPLQSPQSRSE

SEQ ID NO: 247393 - protein, 16 aa, Homo sapiens
  Native (MAGC1_HUMAN)
DDTLYPLQSPQSRSEG

SEQ ID NO: 247394 - protein, 17 aa, Homo sapiens
  Native (MAGC1_HUMAN)
DDTLYPLQSPQSRSEGE

SEQ ID NO: 247395 - protein, 19 aa, Homo sapiens
  Native (MAGC1_HUMAN)
DDTLYPLQSPQSRSEGEDS

SEQ ID NO: 247396 - protein, 20 aa, Homo sapiens
  Native (MAGC1_HUMAN)
DDTLYPLQSPQSRSEGEDSS

SEQ ID NO: 247397 - protein, 21 aa, Homo sapiens
  Native (MAGC1_HUMAN)
DDTLYPLQSPQSRSEGEDSSD

SEQ ID NO: 247398 - protein, 22 aa, Homo sapiens
  Native (MAGC1_HUMAN)
DDTLYPLQSPQSRSEGEDSSDP

SEQ ID NO: 247399 - protein, 23 aa, Homo sapiens
  Native (MAGC1_HUMAN)
DDTLYPLQSPQSRSEGEDSSDPL

SEQ ID NO: 247400 - protein, 24 aa, Homo sapiens
  Native (MAGC1_HUMAN)
DDTLYPLQSPQSRSEGEDSSDPLQ

SEQ ID NO: 247401 - protein, 25 aa, Homo sapiens
  Native (MAGC1_HUMAN)
DDTLYPLQSPQSRSEGEDSSDPLQR

SEQ ID NO: 247402 - protein, 13 aa, Homo sapiens
  Native (MAGC1_HUMAN)
DEKVDELARFLLL

SEQ ID NO: 247403 - protein, 14 aa, Homo sapiens
  Native (MAGC1_HUMAN)
DEKVDELARFLLLK

SEQ ID NO: 247404 - protein, 15 aa, Homo sapiens
  Native (MAGC1_HUMAN)
DEKVDELARFLLLKY

SEQ ID NO: 247405 - protein, 16 aa, Homo sapiens
  Native (MAGC1_HUMAN)
DEKVDELARFLLLKYQ

SEQ ID NO: 247406 - protein, 17 aa, Homo sapiens
  Native (MAGC1_HUMAN)
DEKVDELARFLLLKYQV

SEQ ID NO: 247407 - protein, 18 aa, Homo sapiens
  Native (MAGC1_HUMAN)
DEKVDELARFLLLKYQVK

SEQ ID NO: 247408 - protein, 19 aa, Homo sapiens
  Native (MAGC1_HUMAN)
DEKVDELARFLLLKYQVKQ

SEQ ID NO: 247409 - protein, 20 aa, Homo sapiens
  Native (MAGC1_HUMAN)
DEKVDELARFLLLKYQVKQP

SEQ ID NO: 247410 - protein, 21 aa, Homo sapiens
  Native (MAGC1_HUMAN)
DEKVDELARFLLLKYQVKQPI

SEQ ID NO: 247411 - protein, 22 aa, Homo sapiens
  Native (MAGC1_HUMAN)
DEKVDELARFLLLKYQVKQPIT

SEQ ID NO: 247412 - protein, 23 aa, Homo sapiens
  Native (MAGC1_HUMAN)
DEKVDELARFLLLKYQVKQPITK

SEQ ID NO: 247413 - protein, 24 aa, Homo sapiens
  Native (MAGC1_HUMAN)
DEKVDELARFLLLKYQVKQPITKA

SEQ ID NO: 247414 - protein, 25 aa, Homo sapiens
  Native (MAGC1_HUMAN)
DEKVDELARFLLLKYQVKQPITKAE

SEQ ID NO: 247415 - protein, 13 aa, Homo sapiens
  Native (MAGC1_HUMAN)
DELARFLLLKYQV

SEQ ID NO: 247416 - protein, 14 aa, Homo sapiens
  Native (MAGC1_HUMAN)
DELARFLLLKYQVK

SEQ ID NO: 247417 - protein, 15 aa, Homo sapiens
  Native (MAGC1_HUMAN)
DELARFLLLKYQVKQ

SEQ ID NO: 247418 - protein, 16 aa, Homo sapiens
  Native (MAGC1_HUMAN)
DELARFLLLKYQVKQP

SEQ ID NO: 247419 - protein, 17 aa, Homo sapiens
  Native (MAGC1_HUMAN)
DELARFLLLKYQVKQPI

SEQ ID NO: 247420 - protein, 18 aa, Homo sapiens
  Native (MAGC1_HUMAN)
DELARFLLLKYQVKQPIT

SEQ ID NO: 247421 - protein, 19 aa, Homo sapiens
  Native (MAGC1_HUMAN)
DELARFLLLKYQVKQPITK

SEQ ID NO: 247422 - protein, 20 aa, Homo sapiens
  Native (MAGC1_HUMAN)
DELARFLLLKYQVKQPITKA

SEQ ID NO: 247423 - protein, 21 aa, Homo sapiens
  Native (MAGC1_HUMAN)
DELARFLLLKYQVKQPITKAE

SEQ ID NO: 247424 - protein, 22 aa, Homo sapiens
  Native (MAGC1_HUMAN)
DELARFLLLKYQVKQPITKAEM

SEQ ID NO: 247425 - protein, 23 aa, Homo sapiens
  Native (MAGC1_HUMAN)
DELARFLLLKYQVKQPITKAEML

SEQ ID NO: 247426 - protein, 24 aa, Homo sapiens
  Native (MAGC1_HUMAN)
DELARFLLLKYQVKQPITKAEMLT

SEQ ID NO: 247427 - protein, 25 aa, Homo sapiens
  Native (MAGC1_HUMAN)
DELARFLLLKYQVKQPITKAEMLTN

SEQ ID NO: 247428 - protein, 13 aa, Homo sapiens
  Native (MAGC1_HUMAN)
DEQGMSQNRLLIL

SEQ ID NO: 247429 - protein, 14 aa, Homo sapiens
  Native (MAGC1_HUMAN)
DEQGMSQNRLLILI

SEQ ID NO: 247430 - protein, 15 aa, Homo sapiens
  Native (MAGC1_HUMAN)
DEQGMSQNRLLILIL

SEQ ID NO: 247431 - protein, 16 aa, Homo sapiens
  Native (MAGC1_HUMAN)
DEQGMSQNRLLILILS

SEQ ID NO: 247432 - protein, 17 aa, Homo sapiens
  Native (MAGC1_HUMAN)
DEQGMSQNRLLILILSI

SEQ ID NO: 247433 - protein, 18 aa, Homo sapiens
  Native (MAGC1_HUMAN)
DEQGMSQNRLLILILSII

SEQ ID NO: 247434 - protein, 19 aa, Homo sapiens
  Native (MAGC1_HUMAN)
DEQGMSQNRLLILILSIIF

SEQ ID NO: 247435 - protein, 20 aa, Homo sapiens
  Native (MAGC1_HUMAN)
DEQGMSQNRLLILILSIIFI

SEQ ID NO: 247436 - protein, 21 aa, Homo sapiens
  Native (MAGC1_HUMAN)
DEQGMSQNRLLILILSIIFIK

SEQ ID NO: 247437 - protein, 22 aa, Homo sapiens
  Native (MAGC1_HUMAN)
DEQGMSQNRLLILILSIIFIKG

SEQ ID NO: 247438 - protein, 23 aa, Homo sapiens
  Native (MAGC1_HUMAN)
DEQGMSQNRLLILILSIIFIKGT

SEQ ID NO: 247439 - protein, 24 aa, Homo sapiens
  Native (MAGC1_HUMAN)
DEQGMSQNRLLILILSIIFIKGTY

SEQ ID NO: 247440 - protein, 25 aa, Homo sapiens
  Native (MAGC1_HUMAN)
DEQGMSQNRLLILILSIIFIKGTYA

SEQ ID NO: 247441 - protein, 15 aa, Homo sapiens
  Native (MAGC1_HUMAN)
DEYTSSSDTLLESDS

SEQ ID NO: 247442 - protein, 16 aa, Homo sapiens
  Native (MAGC1_HUMAN)
DEYTSSSDTLLESDSL

SEQ ID NO: 247443 - protein, 19 aa, Homo sapiens
  Native (MAGC1_HUMAN)
DEYTSSSDTLLESDSLTDS

SEQ ID NO: 247444 - protein, 20 aa, Homo sapiens
  Native (MAGC1_HUMAN)
DEYTSSSDTLLESDSLTDSE

SEQ ID NO: 247445 - protein, 22 aa, Homo sapiens
  Native (MAGC1_HUMAN)
DEYTSSSDTLLESDSLTDSESL

SEQ ID NO: 247446 - protein, 23 aa, Homo sapiens
  Native (MAGC1_HUMAN)
DEYTSSSDTLLESDSLTDSESLI

SEQ ID NO: 247447 - protein, 24 aa, Homo sapiens
  Native (MAGC1_HUMAN)
DEYTSSSDTLLESDSLTDSESLIE

SEQ ID NO: 247448 - protein, 25 aa, Homo sapiens
  Native (MAGC1_HUMAN)
DEYTSSSDTLLESDSLTDSESLIES

SEQ ID NO: 247449 - protein, 14 aa, Homo sapiens
  Native (MAGC1_HUMAN)
DFQSSLQSPVSICS

SEQ ID NO: 247450 - protein, 15 aa, Homo sapiens
  Native (MAGC1_HUMAN)
DFQSSLQSPVSICSS

SEQ ID NO: 247451 - protein, 16 aa, Homo sapiens
  Native (MAGC1_HUMAN)
DFQSSLQSPVSICSSS

SEQ ID NO: 247452 - protein, 17 aa, Homo sapiens
  Native (MAGC1_HUMAN)
DFQSSLQSPVSICSSST

SEQ ID NO: 247453 - protein, 19 aa, Homo sapiens
  Native (MAGC1_HUMAN)
DFQSSLQSPVSICSSSTSL

SEQ ID NO: 247454 - protein, 20 aa, Homo sapiens
  Native (MAGC1_HUMAN)
DFQSSLQSPVSICSSSTSLS

SEQ ID NO: 247455 - protein, 21 aa, Homo sapiens
  Native (MAGC1_HUMAN)
DFQSSLQSPVSICSSSTSLSL

SEQ ID NO: 247456 - protein, 22 aa, Homo sapiens
  Native (MAGC1_HUMAN)
DFQSSLQSPVSICSSSTSLSLP

SEQ ID NO: 247457 - protein, 23 aa, Homo sapiens
  Native (MAGC1_HUMAN)
DFQSSLQSPVSICSSSTSLSLPQ

SEQ ID NO: 247458 - protein, 24 aa, Homo sapiens
  Native (MAGC1_HUMAN)
DFQSSLQSPVSICSSSTSLSLPQS

SEQ ID NO: 247459 - protein, 25 aa, Homo sapiens
  Native (MAGC1_HUMAN)
DFQSSLQSPVSICSSSTSLSLPQSF

SEQ ID NO: 247460 - protein, 13 aa, Homo sapiens
  Native (MAGC1_HUMAN)
DKDMPTAGMPSLL

SEQ ID NO: 247461 - protein, 14 aa, Homo sapiens
  Native (MAGC1_HUMAN)
DKDMPTAGMPSLLQ

SEQ ID NO: 247462 - protein, 15 aa, Homo sapiens
  Native (MAGC1_HUMAN)
DKDMPTAGMPSLLQS

SEQ ID NO: 247463 - protein, 16 aa, Homo sapiens
  Native (MAGC1_HUMAN)
DKDMPTAGMPSLLQSS

SEQ ID NO: 247464 - protein, 17 aa, Homo sapiens
  Native (MAGC1_HUMAN)
DKDMPTAGMPSLLQSSS

SEQ ID NO: 247465 - protein, 18 aa, Homo sapiens
  Native (MAGC1_HUMAN)
DKDMPTAGMPSLLQSSSE

SEQ ID NO: 247466 - protein, 19 aa, Homo sapiens
  Native (MAGC1_HUMAN)
DKDMPTAGMPSLLQSSSES

SEQ ID NO: 247467 - protein, 20 aa, Homo sapiens
  Native (MAGC1_HUMAN)
DKDMPTAGMPSLLQSSSESP

SEQ ID NO: 247468 - protein, 21 aa, Homo sapiens
  Native (MAGC1_HUMAN)
DKDMPTAGMPSLLQSSSESPQ

SEQ ID NO: 247469 - protein, 22 aa, Homo sapiens
  Native (MAGC1_HUMAN)
DKDMPTAGMPSLLQSSSESPQS

SEQ ID NO: 247470 - protein, 23 aa, Homo sapiens
  Native (MAGC1_HUMAN)
DKDMPTAGMPSLLQSSSESPQSC

SEQ ID NO: 247471 - protein, 24 aa, Homo sapiens
  Native (MAGC1_HUMAN)
DKDMPTAGMPSLLQSSSESPQSCP

SEQ ID NO: 247472 - protein, 25 aa, Homo sapiens
  Native (MAGC1_HUMAN)
DKDMPTAGMPSLLQSSSESPQSCPE

SEQ ID NO: 247473 - protein, 22 aa, Homo sapiens
  Native (MAGC1_HUMAN)
DLTSEGCLSDEQGMSQNRLLIL

SEQ ID NO: 247474 - protein, 23 aa, Homo sapiens
  Native (MAGC1_HUMAN)
DLTSEGCLSDEQGMSQNRLLILI

SEQ ID NO: 247475 - protein, 24 aa, Homo sapiens
  Native (MAGC1_HUMAN)
DLTSEGCLSDEQGMSQNRLLILIL

SEQ ID NO: 247476 - protein, 25 aa, Homo sapiens
  Native (MAGC1_HUMAN)
DLTSEGCLSDEQGMSQNRLLILILS

SEQ ID NO: 247477 - protein, 13 aa, Homo sapiens
  Native (MAGC1_HUMAN)
DMPTAGMPSLLQS

SEQ ID NO: 247478 - protein, 14 aa, Homo sapiens
  Native (MAGC1_HUMAN)
DMPTAGMPSLLQSS

SEQ ID NO: 247479 - protein, 15 aa, Homo sapiens
  Native (MAGC1_HUMAN)
DMPTAGMPSLLQSSS

SEQ ID NO: 247480 - protein, 16 aa, Homo sapiens
  Native (MAGC1_HUMAN)
DMPTAGMPSLLQSSSE

SEQ ID NO: 247481 - protein, 17 aa, Homo sapiens
  Native (MAGC1_HUMAN)
DMPTAGMPSLLQSSSES

SEQ ID NO: 247482 - protein, 18 aa, Homo sapiens
  Native (MAGC1_HUMAN)
DMPTAGMPSLLQSSSESP

SEQ ID NO: 247483 - protein, 19 aa, Homo sapiens
  Native (MAGC1_HUMAN)
DMPTAGMPSLLQSSSESPQ

SEQ ID NO: 247484 - protein, 20 aa, Homo sapiens
  Native (MAGC1_HUMAN)
DMPTAGMPSLLQSSSESPQS

SEQ ID NO: 247485 - protein, 21 aa, Homo sapiens
  Native (MAGC1_HUMAN)
DMPTAGMPSLLQSSSESPQSC

SEQ ID NO: 247486 - protein, 22 aa, Homo sapiens
  Native (MAGC1_HUMAN)
DMPTAGMPSLLQSSSESPQSCP

SEQ ID NO: 247487 - protein, 23 aa, Homo sapiens
  Native (MAGC1_HUMAN)
DMPTAGMPSLLQSSSESPQSCPE

SEQ ID NO: 247488 - protein, 24 aa, Homo sapiens
  Native (MAGC1_HUMAN)
DMPTAGMPSLLQSSSESPQSCPEG

SEQ ID NO: 247489 - protein, 25 aa, Homo sapiens
  Native (MAGC1_HUMAN)
DMPTAGMPSLLQSSSESPQSCPEGE

SEQ ID NO: 247490 - protein, 14 aa, Homo sapiens
  Native (MAGC1_HUMAN)
DPDDSYVFVNTLDL

SEQ ID NO: 247491 - protein, 15 aa, Homo sapiens
  Native (MAGC1_HUMAN)
DPDDSYVFVNTLDLT

SEQ ID NO: 247492 - protein, 16 aa, Homo sapiens
  Native (MAGC1_HUMAN)
DPDDSYVFVNTLDLTS

SEQ ID NO: 247493 - protein, 17 aa, Homo sapiens
  Native (MAGC1_HUMAN)
DPDDSYVFVNTLDLTSE

SEQ ID NO: 247494 - protein, 18 aa, Homo sapiens
  Native (MAGC1_HUMAN)
DPDDSYVFVNTLDLTSEG

SEQ ID NO: 247495 - protein, 19 aa, Homo sapiens
  Native (MAGC1_HUMAN)
DPDDSYVFVNTLDLTSEGC

SEQ ID NO: 247496 - protein, 20 aa, Homo sapiens
  Native (MAGC1_HUMAN)
DPDDSYVFVNTLDLTSEGCL

SEQ ID NO: 247497 - protein, 21 aa, Homo sapiens
  Native (MAGC1_HUMAN)
DPDDSYVFVNTLDLTSEGCLS

SEQ ID NO: 247498 - protein, 22 aa, Homo sapiens
  Native (MAGC1_HUMAN)
DPDDSYVFVNTLDLTSEGCLSD

SEQ ID NO: 247499 - protein, 23 aa, Homo sapiens
  Native (MAGC1_HUMAN)
DPDDSYVFVNTLDLTSEGCLSDE

SEQ ID NO: 247500 - protein, 24 aa, Homo sapiens
  Native (MAGC1_HUMAN)
DPDDSYVFVNTLDLTSEGCLSDEQ

SEQ ID NO: 247501 - protein, 25 aa, Homo sapiens
  Native (MAGC1_HUMAN)
DPDDSYVFVNTLDLTSEGCLSDEQG

SEQ ID NO: 247502 - protein, 14 aa, Homo sapiens
  Native (MAGC1_HUMAN)
DSESLIESEPLFTY

SEQ ID NO: 247503 - protein, 15 aa, Homo sapiens
  Native (MAGC1_HUMAN)
DSESLIESEPLFTYT

SEQ ID NO: 247504 - protein, 16 aa, Homo sapiens
  Native (MAGC1_HUMAN)
DSESLIESEPLFTYTL

SEQ ID NO: 247505 - protein, 17 aa, Homo sapiens
  Native (MAGC1_HUMAN)
DSESLIESEPLFTYTLD

SEQ ID NO: 247506 - protein, 18 aa, Homo sapiens
  Native (MAGC1_HUMAN)
DSESLIESEPLFTYTLDE

SEQ ID NO: 247507 - protein, 19 aa, Homo sapiens
  Native (MAGC1_HUMAN)
DSESLIESEPLFTYTLDEK

SEQ ID NO: 247508 - protein, 20 aa, Homo sapiens
  Native (MAGC1_HUMAN)
DSESLIESEPLFTYTLDEKV

SEQ ID NO: 247509 - protein, 21 aa, Homo sapiens
  Native (MAGC1_HUMAN)
DSESLIESEPLFTYTLDEKVD

SEQ ID NO: 247510 - protein, 22 aa, Homo sapiens
  Native (MAGC1_HUMAN)
DSESLIESEPLFTYTLDEKVDE

SEQ ID NO: 247511 - protein, 23 aa, Homo sapiens
  Native (MAGC1_HUMAN)
DSESLIESEPLFTYTLDEKVDEL

SEQ ID NO: 247512 - protein, 24 aa, Homo sapiens
  Native (MAGC1_HUMAN)
DSESLIESEPLFTYTLDEKVDELA

SEQ ID NO: 247513 - protein, 25 aa, Homo sapiens
  Native (MAGC1_HUMAN)
DSESLIESEPLFTYTLDEKVDELAR

SEQ ID NO: 247514 - protein, 15 aa, Homo sapiens
  Native (MAGC1_HUMAN)
DSLSPLHFPQFPPQG

SEQ ID NO: 247515 - protein, 16 aa, Homo sapiens
  Native (MAGC1_HUMAN)
DSLSPLHFPQFPPQGE

SEQ ID NO: 247516 - protein, 20 aa, Homo sapiens
  Native (MAGC1_HUMAN)
DSLSPLHFPQFPPQGEDFQS

SEQ ID NO: 247517 - protein, 15 aa, Homo sapiens
  Native (MAGC1_HUMAN)
DSLSPLQIPQSPLEG

SEQ ID NO: 247518 - protein, 20 aa, Homo sapiens
  Native (MAGC1_HUMAN)
DSLSPLQIPQSPLEGEDSLS

SEQ ID NO: 247519 - protein, 25 aa, Homo sapiens
  Native (MAGC1_HUMAN)
DSLSPLQIPQSPLEGEDSLSSLHFP

SEQ ID NO: 247520 - protein, 15 aa, Homo sapiens
  Native (MAGC1_HUMAN)
DSLSSLHFPQSPPEW

SEQ ID NO: 247521 - protein, 16 aa, Homo sapiens
  Native (MAGC1_HUMAN)
DSLSSLHFPQSPPEWE

SEQ ID NO: 247522 - protein, 17 aa, Homo sapiens
  Native (MAGC1_HUMAN)
DSLSSLHFPQSPPEWED

SEQ ID NO: 247523 - protein, 20 aa, Homo sapiens
  Native (MAGC1_HUMAN)
DSLSSLHFPQSPPEWEDSLS

SEQ ID NO: 247524 - protein, 15 aa, Homo sapiens
  Native (MAGC1_HUMAN)
DSLTDSESLIESEPL

SEQ ID NO: 247525 - protein, 16 aa, Homo sapiens
  Native (MAGC1_HUMAN)
DSLTDSESLIESEPLF

SEQ ID NO: 247526 - protein, 17 aa, Homo sapiens
  Native (MAGC1_HUMAN)
DSLTDSESLIESEPLFT

SEQ ID NO: 247527 - protein, 18 aa, Homo sapiens
  Native (MAGC1_HUMAN)
DSLTDSESLIESEPLFTY

SEQ ID NO: 247528 - protein, 19 aa, Homo sapiens
  Native (MAGC1_HUMAN)
DSLTDSESLIESEPLFTYT

SEQ ID NO: 247529 - protein, 20 aa, Homo sapiens
  Native (MAGC1_HUMAN)
DSLTDSESLIESEPLFTYTL

SEQ ID NO: 247530 - protein, 21 aa, Homo sapiens
  Native (MAGC1_HUMAN)
DSLTDSESLIESEPLFTYTLD

SEQ ID NO: 247531 - protein, 22 aa, Homo sapiens
  Native (MAGC1_HUMAN)
DSLTDSESLIESEPLFTYTLDE

SEQ ID NO: 247532 - protein, 23 aa, Homo sapiens
  Native (MAGC1_HUMAN)
DSLTDSESLIESEPLFTYTLDEK

SEQ ID NO: 247533 - protein, 24 aa, Homo sapiens
  Native (MAGC1_HUMAN)
DSLTDSESLIESEPLFTYTLDEKV

SEQ ID NO: 247534 - protein, 25 aa, Homo sapiens
  Native (MAGC1_HUMAN)
DSLTDSESLIESEPLFTYTLDEKVD

SEQ ID NO: 247535 - protein, 15 aa, Homo sapiens
  Native (MAGC1_HUMAN)
DSMSPLYFPQSPLQG

SEQ ID NO: 247536 - protein, 16 aa, Homo sapiens
  Native (MAGC1_HUMAN)
DSMSPLYFPQSPLQGE

SEQ ID NO: 247537 - protein, 17 aa, Homo sapiens
  Native (MAGC1_HUMAN)
DSMSPLYFPQSPLQGEE

SEQ ID NO: 247538 - protein, 18 aa, Homo sapiens
  Native (MAGC1_HUMAN)
DSMSPLYFPQSPLQGEEF

SEQ ID NO: 247539 - protein, 19 aa, Homo sapiens
  Native (MAGC1_HUMAN)
DSMSPLYFPQSPLQGEEFQ

SEQ ID NO: 247540 - protein, 20 aa, Homo sapiens
  Native (MAGC1_HUMAN)
DSMSPLYFPQSPLQGEEFQS

SEQ ID NO: 247541 - protein, 21 aa, Homo sapiens
  Native (MAGC1_HUMAN)
DSMSPLYFPQSPLQGEEFQSS

SEQ ID NO: 247542 - protein, 22 aa, Homo sapiens
  Native (MAGC1_HUMAN)
DSMSPLYFPQSPLQGEEFQSSL

SEQ ID NO: 247543 - protein, 23 aa, Homo sapiens
  Native (MAGC1_HUMAN)
DSMSPLYFPQSPLQGEEFQSSLQ

SEQ ID NO: 247544 - protein, 24 aa, Homo sapiens
  Native (MAGC1_HUMAN)
DSMSPLYFPQSPLQGEEFQSSLQS

SEQ ID NO: 247545 - protein, 25 aa, Homo sapiens
  Native (MAGC1_HUMAN)
DSMSPLYFPQSPLQGEEFQSSLQSP

SEQ ID NO: 247546 - protein, 14 aa, Homo sapiens
  Native (MAGC1_HUMAN)
DSTATESASSSVMS

SEQ ID NO: 247547 - protein, 15 aa, Homo sapiens
  Native (MAGC1_HUMAN)
DSTATESASSSVMSP

SEQ ID NO: 247548 - protein, 16 aa, Homo sapiens
  Native (MAGC1_HUMAN)
DSTATESASSSVMSPS

SEQ ID NO: 247549 - protein, 17 aa, Homo sapiens
  Native (MAGC1_HUMAN)
DSTATESASSSVMSPSF

SEQ ID NO: 247550 - protein, 18 aa, Homo sapiens
  Native (MAGC1_HUMAN)
DSTATESASSSVMSPSFS

SEQ ID NO: 247551 - protein, 19 aa, Homo sapiens
  Native (MAGC1_HUMAN)
DSTATESASSSVMSPSFSS

SEQ ID NO: 247552 - protein, 20 aa, Homo sapiens
  Native (MAGC1_HUMAN)
DSTATESASSSVMSPSFSSE

SEQ ID NO: 247553 - protein, 13 aa, Homo sapiens
  Native (MAGC1_HUMAN)
DSYVFVNTLDLTS

SEQ ID NO: 247554 - protein, 14 aa, Homo sapiens
  Native (MAGC1_HUMAN)
DSYVFVNTLDLTSE

SEQ ID NO: 247555 - protein, 15 aa, Homo sapiens
  Native (MAGC1_HUMAN)
DSYVFVNTLDLTSEG

SEQ ID NO: 247556 - protein, 16 aa, Homo sapiens
  Native (MAGC1_HUMAN)
DSYVFVNTLDLTSEGC

SEQ ID NO: 247557 - protein, 17 aa, Homo sapiens
  Native (MAGC1_HUMAN)
DSYVFVNTLDLTSEGCL

SEQ ID NO: 247558 - protein, 18 aa, Homo sapiens
  Native (MAGC1_HUMAN)
DSYVFVNTLDLTSEGCLS

SEQ ID NO: 247559 - protein, 19 aa, Homo sapiens
  Native (MAGC1_HUMAN)
DSYVFVNTLDLTSEGCLSD

SEQ ID NO: 247560 - protein, 20 aa, Homo sapiens
  Native (MAGC1_HUMAN)
DSYVFVNTLDLTSEGCLSDE

SEQ ID NO: 247561 - protein, 21 aa, Homo sapiens
  Native (MAGC1_HUMAN)
DSYVFVNTLDLTSEGCLSDEQ

SEQ ID NO: 247562 - protein, 22 aa, Homo sapiens
  Native (MAGC1_HUMAN)
DSYVFVNTLDLTSEGCLSDEQG

SEQ ID NO: 247563 - protein, 23 aa, Homo sapiens
  Native (MAGC1_HUMAN)
DSYVFVNTLDLTSEGCLSDEQGM

SEQ ID NO: 247564 - protein, 24 aa, Homo sapiens
  Native (MAGC1_HUMAN)
DSYVFVNTLDLTSEGCLSDEQGMS

SEQ ID NO: 247565 - protein, 25 aa, Homo sapiens
  Native (MAGC1_HUMAN)
DSYVFVNTLDLTSEGCLSDEQGMSQ

SEQ ID NO: 247566 - protein, 23 aa, Homo sapiens
  Native (MAGC1_HUMAN)
DTLLESDSLTDSESLIESEPLFT

SEQ ID NO: 247567 - protein, 24 aa, Homo sapiens
  Native (MAGC1_HUMAN)
DTLLESDSLTDSESLIESEPLFTY

SEQ ID NO: 247568 - protein, 25 aa, Homo sapiens
  Native (MAGC1_HUMAN)
DTLLESDSLTDSESLIESEPLFTYT

SEQ ID NO: 247569 - protein, 13 aa, Homo sapiens
  Native (MAGC1_HUMAN)
DTLYPLQSPQSRS

SEQ ID NO: 247570 - protein, 14 aa, Homo sapiens
  Native (MAGC1_HUMAN)
DTLYPLQSPQSRSE

SEQ ID NO: 247571 - protein, 15 aa, Homo sapiens
  Native (MAGC1_HUMAN)
DTLYPLQSPQSRSEG

SEQ ID NO: 247572 - protein, 16 aa, Homo sapiens
  Native (MAGC1_HUMAN)
DTLYPLQSPQSRSEGE

SEQ ID NO: 247573 - protein, 17 aa, Homo sapiens
  Native (MAGC1_HUMAN)
DTLYPLQSPQSRSEGED

SEQ ID NO: 247574 - protein, 19 aa, Homo sapiens
  Native (MAGC1_HUMAN)
DTLYPLQSPQSRSEGEDSS

SEQ ID NO: 247575 - protein, 20 aa, Homo sapiens
  Native (MAGC1_HUMAN)
DTLYPLQSPQSRSEGEDSSD

SEQ ID NO: 247576 - protein, 21 aa, Homo sapiens
  Native (MAGC1_HUMAN)
DTLYPLQSPQSRSEGEDSSDP

SEQ ID NO: 247577 - protein, 22 aa, Homo sapiens
  Native (MAGC1_HUMAN)
DTLYPLQSPQSRSEGEDSSDPL

SEQ ID NO: 247578 - protein, 23 aa, Homo sapiens
  Native (MAGC1_HUMAN)
DTLYPLQSPQSRSEGEDSSDPLQ

SEQ ID NO: 247579 - protein, 24 aa, Homo sapiens
  Native (MAGC1_HUMAN)
DTLYPLQSPQSRSEGEDSSDPLQR

SEQ ID NO: 247580 - protein, 25 aa, Homo sapiens
  Native (MAGC1_HUMAN)
DTLYPLQSPQSRSEGEDSSDPLQRP

SEQ ID NO: 247581 - protein, 15 aa, Homo sapiens
  Native (MAGC1_HUMAN)
DTTDDSTATESASSS

SEQ ID NO: 247582 - protein, 16 aa, Homo sapiens
  Native (MAGC1_HUMAN)
DTTDDSTATESASSSV

SEQ ID NO: 247583 - protein, 17 aa, Homo sapiens
  Native (MAGC1_HUMAN)
DTTDDSTATESASSSVM

SEQ ID NO: 247584 - protein, 18 aa, Homo sapiens
  Native (MAGC1_HUMAN)
DTTDDSTATESASSSVMS

SEQ ID NO: 247585 - protein, 19 aa, Homo sapiens
  Native (MAGC1_HUMAN)
DTTDDSTATESASSSVMSP

SEQ ID NO: 247586 - protein, 20 aa, Homo sapiens
  Native (MAGC1_HUMAN)
DTTDDSTATESASSSVMSPS

SEQ ID NO: 247587 - protein, 21 aa, Homo sapiens
  Native (MAGC1_HUMAN)
DTTDDSTATESASSSVMSPSF

SEQ ID NO: 247588 - protein, 22 aa, Homo sapiens
  Native (MAGC1_HUMAN)
DTTDDSTATESASSSVMSPSFS

SEQ ID NO: 247589 - protein, 23 aa, Homo sapiens
  Native (MAGC1_HUMAN)
DTTDDSTATESASSSVMSPSFSS

SEQ ID NO: 247590 - protein, 24 aa, Homo sapiens
  Native (MAGC1_HUMAN)
DTTDDSTATESASSSVMSPSFSSE

SEQ ID NO: 247591 - protein, 19 aa, Homo sapiens
  Native (MAGC1_HUMAN)
DVEERAQAIIDTTDDSTAT

SEQ ID NO: 247592 - protein, 20 aa, Homo sapiens
  Native (MAGC1_HUMAN)
DVEERAQAIIDTTDDSTATE

SEQ ID NO: 247593 - protein, 25 aa, Homo sapiens
  Native (MAGC1_HUMAN)
DVEERAQAIIDTTDDSTATESASSS

SEQ ID NO: 247594 - protein, 13 aa, Homo sapiens
  Native (MAGC1_HUMAN)
DVLSGIGVRAGRE

SEQ ID NO: 247595 - protein, 14 aa, Homo sapiens
  Native (MAGC1_HUMAN)
DVLSGIGVRAGREH

SEQ ID NO: 247596 - protein, 15 aa, Homo sapiens
  Native (MAGC1_HUMAN)
DVLSGIGVRAGREHF

SEQ ID NO: 247597 - protein, 16 aa, Homo sapiens
  Native (MAGC1_HUMAN)
DVLSGIGVRAGREHFA

SEQ ID NO: 247598 - protein, 17 aa, Homo sapiens
  Native (MAGC1_HUMAN)
DVLSGIGVRAGREHFAF

SEQ ID NO: 247599 - protein, 18 aa, Homo sapiens
  Native (MAGC1_HUMAN)
DVLSGIGVRAGREHFAFG

SEQ ID NO: 247600 - protein, 19 aa, Homo sapiens
  Native (MAGC1_HUMAN)
DVLSGIGVRAGREHFAFGE

SEQ ID NO: 247601 - protein, 20 aa, Homo sapiens
  Native (MAGC1_HUMAN)
DVLSGIGVRAGREHFAFGEP

SEQ ID NO: 247602 - protein, 21 aa, Homo sapiens
  Native (MAGC1_HUMAN)
DVLSGIGVRAGREHFAFGEPR

SEQ ID NO: 247603 - protein, 22 aa, Homo sapiens
  Native (MAGC1_HUMAN)
DVLSGIGVRAGREHFAFGEPRE

SEQ ID NO: 247604 - protein, 23 aa, Homo sapiens
  Native (MAGC1_HUMAN)
DVLSGIGVRAGREHFAFGEPREL

SEQ ID NO: 247605 - protein, 24 aa, Homo sapiens
  Native (MAGC1_HUMAN)
DVLSGIGVRAGREHFAFGEPRELL

SEQ ID NO: 247606 - protein, 25 aa, Homo sapiens
  Native (MAGC1_HUMAN)
DVLSGIGVRAGREHFAFGEPRELLT

SEQ ID NO: 247607 - protein, 15 aa, Homo sapiens
  Native (MAGC1_HUMAN)
DVQSPLQNPASSFFS

SEQ ID NO: 247608 - protein, 16 aa, Homo sapiens
  Native (MAGC1_HUMAN)
DVQSPLQNPASSFFSS

SEQ ID NO: 247609 - protein, 17 aa, Homo sapiens
  Native (MAGC1_HUMAN)
DVQSPLQNPASSFFSSA

SEQ ID NO: 247610 - protein, 18 aa, Homo sapiens
  Native (MAGC1_HUMAN)
DVQSPLQNPASSFFSSAL

SEQ ID NO: 247611 - protein, 19 aa, Homo sapiens
  Native (MAGC1_HUMAN)
DVQSPLQNPASSFFSSALL

SEQ ID NO: 247612 - protein, 20 aa, Homo sapiens
  Native (MAGC1_HUMAN)
DVQSPLQNPASSFFSSALLS

SEQ ID NO: 247613 - protein, 21 aa, Homo sapiens
  Native (MAGC1_HUMAN)
DVQSPLQNPASSFFSSALLSI

SEQ ID NO: 247614 - protein, 22 aa, Homo sapiens
  Native (MAGC1_HUMAN)
DVQSPLQNPASSFFSSALLSIF

SEQ ID NO: 247615 - protein, 23 aa, Homo sapiens
  Native (MAGC1_HUMAN)
DVQSPLQNPASSFFSSALLSIFQ

SEQ ID NO: 247616 - protein, 24 aa, Homo sapiens
  Native (MAGC1_HUMAN)
DVQSPLQNPASSFFSSALLSIFQS

SEQ ID NO: 247617 - protein, 25 aa, Homo sapiens
  Native (MAGC1_HUMAN)
DVQSPLQNPASSFFSSALLSIFQSS

SEQ ID NO: 247618 - protein, 15 aa, Homo sapiens
  Native (MAGC1_HUMAN)
ECTQSTFEGFPQSPL

SEQ ID NO: 247619 - protein, 16 aa, Homo sapiens
  Native (MAGC1_HUMAN)
ECTQSTFEGFPQSPLQ

SEQ ID NO: 247620 - protein, 17 aa, Homo sapiens
  Native (MAGC1_HUMAN)
ECTQSTFEGFPQSPLQI

SEQ ID NO: 247621 - protein, 18 aa, Homo sapiens
  Native (MAGC1_HUMAN)
ECTQSTFEGFPQSPLQIP

SEQ ID NO: 247622 - protein, 19 aa, Homo sapiens
  Native (MAGC1_HUMAN)
ECTQSTFEGFPQSPLQIPQ

SEQ ID NO: 247623 - protein, 20 aa, Homo sapiens
  Native (MAGC1_HUMAN)
ECTQSTFEGFPQSPLQIPQS

SEQ ID NO: 247624 - protein, 21 aa, Homo sapiens
  Native (MAGC1_HUMAN)
ECTQSTFEGFPQSPLQIPQSP

SEQ ID NO: 247625 - protein, 22 aa, Homo sapiens
  Native (MAGC1_HUMAN)
ECTQSTFEGFPQSPLQIPQSPP

SEQ ID NO: 247626 - protein, 23 aa, Homo sapiens
  Native (MAGC1_HUMAN)
ECTQSTFEGFPQSPLQIPQSPPE

SEQ ID NO: 247627 - protein, 24 aa, Homo sapiens
  Native (MAGC1_HUMAN)
ECTQSTFEGFPQSPLQIPQSPPEG

SEQ ID NO: 247628 - protein, 25 aa, Homo sapiens
  Native (MAGC1_HUMAN)
ECTQSTFEGFPQSPLQIPQSPPEGE

SEQ ID NO: 247629 - protein, 13 aa, Homo sapiens
  Native (MAGC1_HUMAN)
EDFQSSLQSPVSI

SEQ ID NO: 247630 - protein, 14 aa, Homo sapiens
  Native (MAGC1_HUMAN)
EDFQSSLQSPVSIC

SEQ ID NO: 247631 - protein, 15 aa, Homo sapiens
  Native (MAGC1_HUMAN)
EDFQSSLQSPVSICS

SEQ ID NO: 247632 - protein, 16 aa, Homo sapiens
  Native (MAGC1_HUMAN)
EDFQSSLQSPVSICSS

SEQ ID NO: 247633 - protein, 17 aa, Homo sapiens
  Native (MAGC1_HUMAN)
EDFQSSLQSPVSICSSS

SEQ ID NO: 247634 - protein, 19 aa, Homo sapiens
  Native (MAGC1_HUMAN)
EDFQSSLQSPVSICSSSTS

SEQ ID NO: 247635 - protein, 20 aa, Homo sapiens
  Native (MAGC1_HUMAN)
EDFQSSLQSPVSICSSSTSL

SEQ ID NO: 247636 - protein, 21 aa, Homo sapiens
  Native (MAGC1_HUMAN)
EDFQSSLQSPVSICSSSTSLS

SEQ ID NO: 247637 - protein, 22 aa, Homo sapiens
  Native (MAGC1_HUMAN)
EDFQSSLQSPVSICSSSTSLSL

SEQ ID NO: 247638 - protein, 23 aa, Homo sapiens
  Native (MAGC1_HUMAN)
EDFQSSLQSPVSICSSSTSLSLP

SEQ ID NO: 247639 - protein, 24 aa, Homo sapiens
  Native (MAGC1_HUMAN)
EDFQSSLQSPVSICSSSTSLSLPQ

SEQ ID NO: 247640 - protein, 25 aa, Homo sapiens
  Native (MAGC1_HUMAN)
EDFQSSLQSPVSICSSSTSLSLPQS

SEQ ID NO: 247641 - protein, 15 aa, Homo sapiens
  Native (MAGC1_HUMAN)
EDSLSPLHFPQFPPQ

SEQ ID NO: 247642 - protein, 16 aa, Homo sapiens
  Native (MAGC1_HUMAN)
EDSLSPLHFPQFPPQG

SEQ ID NO: 247643 - protein, 17 aa, Homo sapiens
  Native (MAGC1_HUMAN)
EDSLSPLHFPQFPPQGE

SEQ ID NO: 247644 - protein, 20 aa, Homo sapiens
  Native (MAGC1_HUMAN)
EDSLSPLHFPQFPPQGEDFQ

SEQ ID NO: 247645 - protein, 22 aa, Homo sapiens
  Native (MAGC1_HUMAN)
EDSLSPLHFPQFPPQGEDFQSS

SEQ ID NO: 247646 - protein, 23 aa, Homo sapiens
  Native (MAGC1_HUMAN)
EDSLSPLHFPQFPPQGEDFQSSL

SEQ ID NO: 247647 - protein, 24 aa, Homo sapiens
  Native (MAGC1_HUMAN)
EDSLSPLHFPQFPPQGEDFQSSLQ

SEQ ID NO: 247648 - protein, 25 aa, Homo sapiens
  Native (MAGC1_HUMAN)
EDSLSPLHFPQFPPQGEDFQSSLQS

SEQ ID NO: 247649 - protein, 14 aa, Homo sapiens
  Native (MAGC1_HUMAN)
EDSLSPLQIPQSPL

SEQ ID NO: 247650 - protein, 15 aa, Homo sapiens
  Native (MAGC1_HUMAN)
EDSLSPLQIPQSPLE

SEQ ID NO: 247651 - protein, 16 aa, Homo sapiens
  Native (MAGC1_HUMAN)
EDSLSPLQIPQSPLEG

SEQ ID NO: 247652 - protein, 17 aa, Homo sapiens
  Native (MAGC1_HUMAN)
EDSLSPLQIPQSPLEGE

SEQ ID NO: 247653 - protein, 20 aa, Homo sapiens
  Native (MAGC1_HUMAN)
EDSLSPLQIPQSPLEGEDSL

SEQ ID NO: 247654 - protein, 24 aa, Homo sapiens
  Native (MAGC1_HUMAN)
EDSLSPLQIPQSPLEGEDSLSSLH

SEQ ID NO: 247655 - protein, 25 aa, Homo sapiens
  Native (MAGC1_HUMAN)
EDSLSPLQIPQSPLEGEDSLSSLHF

SEQ ID NO: 247656 - protein, 14 aa, Homo sapiens
  Native (MAGC1_HUMAN)
EDSLSSLHFPQSPP

SEQ ID NO: 247657 - protein, 15 aa, Homo sapiens
  Native (MAGC1_HUMAN)
EDSLSSLHFPQSPPE

SEQ ID NO: 247658 - protein, 16 aa, Homo sapiens
  Native (MAGC1_HUMAN)
EDSLSSLHFPQSPPEW

SEQ ID NO: 247659 - protein, 17 aa, Homo sapiens
  Native (MAGC1_HUMAN)
EDSLSSLHFPQSPPEWE

SEQ ID NO: 247660 - protein, 19 aa, Homo sapiens
  Native (MAGC1_HUMAN)
EDSLSSLHFPQSPPEWEDS

SEQ ID NO: 247661 - protein, 20 aa, Homo sapiens
  Native (MAGC1_HUMAN)
EDSLSSLHFPQSPPEWEDSL

SEQ ID NO: 247662 - protein, 21 aa, Homo sapiens
  Native (MAGC1_HUMAN)
EDSLSSLHFPQSPPEWEDSLS

SEQ ID NO: 247663 - protein, 22 aa, Homo sapiens
  Native (MAGC1_HUMAN)
EDSLSSLHFPQSPPEWEDSLSP

SEQ ID NO: 247664 - protein, 23 aa, Homo sapiens
  Native (MAGC1_HUMAN)
EDSLSSLHFPQSPPEWEDSLSPL

SEQ ID NO: 247665 - protein, 24 aa, Homo sapiens
  Native (MAGC1_HUMAN)
EDSLSSLHFPQSPPEWEDSLSPLH

SEQ ID NO: 247666 - protein, 25 aa, Homo sapiens
  Native (MAGC1_HUMAN)
EDSLSSLHFPQSPPEWEDSLSPLHF

SEQ ID NO: 247667 - protein, 15 aa, Homo sapiens
  Native (MAGC1_HUMAN)
EDSMSPLYFPQSPLQ

SEQ ID NO: 247668 - protein, 16 aa, Homo sapiens
  Native (MAGC1_HUMAN)
EDSMSPLYFPQSPLQG

SEQ ID NO: 247669 - protein, 17 aa, Homo sapiens
  Native (MAGC1_HUMAN)
EDSMSPLYFPQSPLQGE

SEQ ID NO: 247670 - protein, 18 aa, Homo sapiens
  Native (MAGC1_HUMAN)
EDSMSPLYFPQSPLQGEE

SEQ ID NO: 247671 - protein, 19 aa, Homo sapiens
  Native (MAGC1_HUMAN)
EDSMSPLYFPQSPLQGEEF

SEQ ID NO: 247672 - protein, 20 aa, Homo sapiens
  Native (MAGC1_HUMAN)
EDSMSPLYFPQSPLQGEEFQ

SEQ ID NO: 247673 - protein, 21 aa, Homo sapiens
  Native (MAGC1_HUMAN)
EDSMSPLYFPQSPLQGEEFQS

SEQ ID NO: 247674 - protein, 22 aa, Homo sapiens
  Native (MAGC1_HUMAN)
EDSMSPLYFPQSPLQGEEFQSS

SEQ ID NO: 247675 - protein, 23 aa, Homo sapiens
  Native (MAGC1_HUMAN)
EDSMSPLYFPQSPLQGEEFQSSL

SEQ ID NO: 247676 - protein, 24 aa, Homo sapiens
  Native (MAGC1_HUMAN)
EDSMSPLYFPQSPLQGEEFQSSLQ

SEQ ID NO: 247677 - protein, 25 aa, Homo sapiens
  Native (MAGC1_HUMAN)
EDSMSPLYFPQSPLQGEEFQSSLQS

SEQ ID NO: 247678 - protein, 19 aa, Homo sapiens
  Native (MAGC1_HUMAN)
EDVQSPLQNPASSFFSSAL

SEQ ID NO: 247679 - protein, 20 aa, Homo sapiens
  Native (MAGC1_HUMAN)
EDVQSPLQNPASSFFSSALL

SEQ ID NO: 247680 - protein, 21 aa, Homo sapiens
  Native (MAGC1_HUMAN)
EDVQSPLQNPASSFFSSALLS

SEQ ID NO: 247681 - protein, 22 aa, Homo sapiens
  Native (MAGC1_HUMAN)
EDVQSPLQNPASSFFSSALLSI

SEQ ID NO: 247682 - protein, 23 aa, Homo sapiens
  Native (MAGC1_HUMAN)
EDVQSPLQNPASSFFSSALLSIF

SEQ ID NO: 247683 - protein, 24 aa, Homo sapiens
  Native (MAGC1_HUMAN)
EDVQSPLQNPASSFFSSALLSIFQ

SEQ ID NO: 247684 - protein, 25 aa, Homo sapiens
  Native (MAGC1_HUMAN)
EDVQSPLQNPASSFFSSALLSIFQS

SEQ ID NO: 247685 - protein, 13 aa, Homo sapiens
  Native (MAGC1_HUMAN)
EEFQSSLQSPVSI

SEQ ID NO: 247686 - protein, 14 aa, Homo sapiens
  Native (MAGC1_HUMAN)
EEFQSSLQSPVSIC

SEQ ID NO: 247687 - protein, 15 aa, Homo sapiens
  Native (MAGC1_HUMAN)
EEFQSSLQSPVSICS

SEQ ID NO: 247688 - protein, 16 aa, Homo sapiens
  Native (MAGC1_HUMAN)
EEFQSSLQSPVSICSS

SEQ ID NO: 247689 - protein, 17 aa, Homo sapiens
  Native (MAGC1_HUMAN)
EEFQSSLQSPVSICSSS

SEQ ID NO: 247690 - protein, 19 aa, Homo sapiens
  Native (MAGC1_HUMAN)
EEFQSSLQSPVSICSSSTP

SEQ ID NO: 247691 - protein, 20 aa, Homo sapiens
  Native (MAGC1_HUMAN)
EEFQSSLQSPVSICSSSTPS

SEQ ID NO: 247692 - protein, 21 aa, Homo sapiens
  Native (MAGC1_HUMAN)
EEFQSSLQSPVSICSSSTPSS

SEQ ID NO: 247693 - protein, 22 aa, Homo sapiens
  Native (MAGC1_HUMAN)
EEFQSSLQSPVSICSSSTPSSL

SEQ ID NO: 247694 - protein, 23 aa, Homo sapiens
  Native (MAGC1_HUMAN)
EEFQSSLQSPVSICSSSTPSSLP

SEQ ID NO: 247695 - protein, 24 aa, Homo sapiens
  Native (MAGC1_HUMAN)
EEFQSSLQSPVSICSSSTPSSLPQ

SEQ ID NO: 247696 - protein, 25 aa, Homo sapiens
  Native (MAGC1_HUMAN)
EEFQSSLQSPVSICSSSTPSSLPQS

SEQ ID NO: 247697 - protein, 16 aa, Homo sapiens
  Native (MAGC1_HUMAN)
EERAQAIIDTTDDSTA

SEQ ID NO: 247698 - protein, 20 aa, Homo sapiens
  Native (MAGC1_HUMAN)
EERAQAIIDTTDDSTATESA

SEQ ID NO: 247699 - protein, 24 aa, Homo sapiens
  Native (MAGC1_HUMAN)
EERAQAIIDTTDDSTATESASSSV

SEQ ID NO: 247700 - protein, 25 aa, Homo sapiens
  Native (MAGC1_HUMAN)
EERAQAIIDTTDDSTATESASSSVM

SEQ ID NO: 247701 - protein, 20 aa, Homo sapiens
  Native (MAGC1_HUMAN)
EESSSPVDEYTSSSDTLLES

SEQ ID NO: 247702 - protein, 22 aa, Homo sapiens
  Native (MAGC1_HUMAN)
EESSSPVDEYTSSSDTLLESDS

SEQ ID NO: 247703 - protein, 23 aa, Homo sapiens
  Native (MAGC1_HUMAN)
EESSSPVDEYTSSSDTLLESDSL

SEQ ID NO: 247704 - protein, 24 aa, Homo sapiens
  Native (MAGC1_HUMAN)
EESSSPVDEYTSSSDTLLESDSLT

SEQ ID NO: 247705 - protein, 25 aa, Homo sapiens
  Native (MAGC1_HUMAN)
EESSSPVDEYTSSSDTLLESDSLTD

SEQ ID NO: 247706 - protein, 13 aa, Homo sapiens
  Native (MAGC1_HUMAN)
EEVIWDVLSGIGV

SEQ ID NO: 247707 - protein, 14 aa, Homo sapiens
  Native (MAGC1_HUMAN)
EEVIWDVLSGIGVR

SEQ ID NO: 247708 - protein, 15 aa, Homo sapiens
  Native (MAGC1_HUMAN)
EEVIWDVLSGIGVRA

SEQ ID NO: 247709 - protein, 16 aa, Homo sapiens
  Native (MAGC1_HUMAN)
EEVIWDVLSGIGVRAG

SEQ ID NO: 247710 - protein, 17 aa, Homo sapiens
  Native (MAGC1_HUMAN)
EEVIWDVLSGIGVRAGR

SEQ ID NO: 247711 - protein, 18 aa, Homo sapiens
  Native (MAGC1_HUMAN)
EEVIWDVLSGIGVRAGRE

SEQ ID NO: 247712 - protein, 19 aa, Homo sapiens
  Native (MAGC1_HUMAN)
EEVIWDVLSGIGVRAGREH

SEQ ID NO: 247713 - protein, 20 aa, Homo sapiens
  Native (MAGC1_HUMAN)
EEVIWDVLSGIGVRAGREHF

SEQ ID NO: 247714 - protein, 21 aa, Homo sapiens
  Native (MAGC1_HUMAN)
EEVIWDVLSGIGVRAGREHFA

SEQ ID NO: 247715 - protein, 22 aa, Homo sapiens
  Native (MAGC1_HUMAN)
EEVIWDVLSGIGVRAGREHFAF

SEQ ID NO: 247716 - protein, 23 aa, Homo sapiens
  Native (MAGC1_HUMAN)
EEVIWDVLSGIGVRAGREHFAFG

SEQ ID NO: 247717 - protein, 24 aa, Homo sapiens
  Native (MAGC1_HUMAN)
EEVIWDVLSGIGVRAGREHFAFGE

SEQ ID NO: 247718 - protein, 25 aa, Homo sapiens
  Native (MAGC1_HUMAN)
EEVIWDVLSGIGVRAGREHFAFGEP

SEQ ID NO: 247719 - protein, 13 aa, Homo sapiens
  Native (MAGC1_HUMAN)
EFIEILFGISLRE

SEQ ID NO: 247720 - protein, 14 aa, Homo sapiens
  Native (MAGC1_HUMAN)
EFIEILFGISLREV

SEQ ID NO: 247721 - protein, 15 aa, Homo sapiens
  Native (MAGC1_HUMAN)
EFIEILFGISLREVD

SEQ ID NO: 247722 - protein, 16 aa, Homo sapiens
  Native (MAGC1_HUMAN)
EFIEILFGISLREVDP

SEQ ID NO: 247723 - protein, 17 aa, Homo sapiens
  Native (MAGC1_HUMAN)
EFIEILFGISLREVDPD

SEQ ID NO: 247724 - protein, 18 aa, Homo sapiens
  Native (MAGC1_HUMAN)
EFIEILFGISLREVDPDD

SEQ ID NO: 247725 - protein, 19 aa, Homo sapiens
  Native (MAGC1_HUMAN)
EFIEILFGISLREVDPDDS

SEQ ID NO: 247726 - protein, 20 aa, Homo sapiens
  Native (MAGC1_HUMAN)
EFIEILFGISLREVDPDDSY

SEQ ID NO: 247727 - protein, 21 aa, Homo sapiens
  Native (MAGC1_HUMAN)
EFIEILFGISLREVDPDDSYV

SEQ ID NO: 247728 - protein, 22 aa, Homo sapiens
  Native (MAGC1_HUMAN)
EFIEILFGISLREVDPDDSYVF

SEQ ID NO: 247729 - protein, 23 aa, Homo sapiens
  Native (MAGC1_HUMAN)
EFIEILFGISLREVDPDDSYVFV

SEQ ID NO: 247730 - protein, 24 aa, Homo sapiens
  Native (MAGC1_HUMAN)
EFIEILFGISLREVDPDDSYVFVN

SEQ ID NO: 247731 - protein, 25 aa, Homo sapiens
  Native (MAGC1_HUMAN)
EFIEILFGISLREVDPDDSYVFVNT

SEQ ID NO: 247732 - protein, 13 aa, Homo sapiens
  Native (MAGC1_HUMAN)
EFLAMLKNTVPIT

SEQ ID NO: 247733 - protein, 14 aa, Homo sapiens
  Native (MAGC1_HUMAN)
EFLAMLKNTVPITF

SEQ ID NO: 247734 - protein, 15 aa, Homo sapiens
  Native (MAGC1_HUMAN)
EFLAMLKNTVPITFP

SEQ ID NO: 247735 - protein, 16 aa, Homo sapiens
  Native (MAGC1_HUMAN)
EFLAMLKNTVPITFPS

SEQ ID NO: 247736 - protein, 17 aa, Homo sapiens
  Native (MAGC1_HUMAN)
EFLAMLKNTVPITFPSS

SEQ ID NO: 247737 - protein, 18 aa, Homo sapiens
  Native (MAGC1_HUMAN)
EFLAMLKNTVPITFPSSY

SEQ ID NO: 247738 - protein, 19 aa, Homo sapiens
  Native (MAGC1_HUMAN)
EFLAMLKNTVPITFPSSYK

SEQ ID NO: 247739 - protein, 20 aa, Homo sapiens
  Native (MAGC1_HUMAN)
EFLAMLKNTVPITFPSSYKD

SEQ ID NO: 247740 - protein, 21 aa, Homo sapiens
  Native (MAGC1_HUMAN)
EFLAMLKNTVPITFPSSYKDA

SEQ ID NO: 247741 - protein, 22 aa, Homo sapiens
  Native (MAGC1_HUMAN)
EFLAMLKNTVPITFPSSYKDAL

SEQ ID NO: 247742 - protein, 23 aa, Homo sapiens
  Native (MAGC1_HUMAN)
EFLAMLKNTVPITFPSSYKDALK

SEQ ID NO: 247743 - protein, 24 aa, Homo sapiens
  Native (MAGC1_HUMAN)
EFLAMLKNTVPITFPSSYKDALKD

SEQ ID NO: 247744 - protein, 25 aa, Homo sapiens
  Native (MAGC1_HUMAN)
EFLAMLKNTVPITFPSSYKDALKDV

SEQ ID NO: 247745 - protein, 14 aa, Homo sapiens
  Native (MAGC1_HUMAN)
EFLWGPRAHSEVIK

SEQ ID NO: 247746 - protein, 15 aa, Homo sapiens
  Native (MAGC1_HUMAN)
EFLWGPRAHSEVIKR

SEQ ID NO: 247747 - protein, 16 aa, Homo sapiens
  Native (MAGC1_HUMAN)
EFLWGPRAHSEVIKRK

SEQ ID NO: 247748 - protein, 17 aa, Homo sapiens
  Native (MAGC1_HUMAN)
EFLWGPRAHSEVIKRKV

SEQ ID NO: 247749 - protein, 19 aa, Homo sapiens
  Native (MAGC1_HUMAN)
EFLWGPRAHSEVIKRKVVE

SEQ ID NO: 247750 - protein, 20 aa, Homo sapiens
  Native (MAGC1_HUMAN)
EFLWGPRAHSEVIKRKVVEF

SEQ ID NO: 247751 - protein, 21 aa, Homo sapiens
  Native (MAGC1_HUMAN)
EFLWGPRAHSEVIKRKVVEFL

SEQ ID NO: 247752 - protein, 22 aa, Homo sapiens
  Native (MAGC1_HUMAN)
EFLWGPRAHSEVIKRKVVEFLA

SEQ ID NO: 247753 - protein, 23 aa, Homo sapiens
  Native (MAGC1_HUMAN)
EFLWGPRAHSEVIKRKVVEFLAM

SEQ ID NO: 247754 - protein, 24 aa, Homo sapiens
  Native (MAGC1_HUMAN)
EFLWGPRAHSEVIKRKVVEFLAML

SEQ ID NO: 247755 - protein, 25 aa, Homo sapiens
  Native (MAGC1_HUMAN)
EFLWGPRAHSEVIKRKVVEFLAMLK

SEQ ID NO: 247756 - protein, 14 aa, Homo sapiens
  Native (MAGC1_HUMAN)
EFQSSLQSPVSICS

SEQ ID NO: 247757 - protein, 15 aa, Homo sapiens
  Native (MAGC1_HUMAN)
EFQSSLQSPVSICSS

SEQ ID NO: 247758 - protein, 16 aa, Homo sapiens
  Native (MAGC1_HUMAN)
EFQSSLQSPVSICSSS

SEQ ID NO: 247759 - protein, 17 aa, Homo sapiens
  Native (MAGC1_HUMAN)
EFQSSLQSPVSICSSST

SEQ ID NO: 247760 - protein, 19 aa, Homo sapiens
  Native (MAGC1_HUMAN)
EFQSSLQSPVSICSSSTPS

SEQ ID NO: 247761 - protein, 20 aa, Homo sapiens
  Native (MAGC1_HUMAN)
EFQSSLQSPVSICSSSTPSS

SEQ ID NO: 247762 - protein, 21 aa, Homo sapiens
  Native (MAGC1_HUMAN)
EFQSSLQSPVSICSSSTPSSL

SEQ ID NO: 247763 - protein, 22 aa, Homo sapiens
  Native (MAGC1_HUMAN)
EFQSSLQSPVSICSSSTPSSLP

SEQ ID NO: 247764 - protein, 23 aa, Homo sapiens
  Native (MAGC1_HUMAN)
EFQSSLQSPVSICSSSTPSSLPQ

SEQ ID NO: 247765 - protein, 24 aa, Homo sapiens
  Native (MAGC1_HUMAN)
EFQSSLQSPVSICSSSTPSSLPQS

SEQ ID NO: 247766 - protein, 25 aa, Homo sapiens
  Native (MAGC1_HUMAN)
EFQSSLQSPVSICSSSTPSSLPQSF

SEQ ID NO: 247767 - protein, 18 aa, Homo sapiens
  Native (MAGC1_HUMAN)
EGCLSDEQGMSQNRLLIL

SEQ ID NO: 247768 - protein, 19 aa, Homo sapiens
  Native (MAGC1_HUMAN)
EGCLSDEQGMSQNRLLILI

SEQ ID NO: 247769 - protein, 20 aa, Homo sapiens
  Native (MAGC1_HUMAN)
EGCLSDEQGMSQNRLLILIL

SEQ ID NO: 247770 - protein, 21 aa, Homo sapiens
  Native (MAGC1_HUMAN)
EGCLSDEQGMSQNRLLILILS

SEQ ID NO: 247771 - protein, 22 aa, Homo sapiens
  Native (MAGC1_HUMAN)
EGCLSDEQGMSQNRLLILILSI

SEQ ID NO: 247772 - protein, 23 aa, Homo sapiens
  Native (MAGC1_HUMAN)
EGCLSDEQGMSQNRLLILILSII

SEQ ID NO: 247773 - protein, 24 aa, Homo sapiens
  Native (MAGC1_HUMAN)
EGCLSDEQGMSQNRLLILILSIIF

SEQ ID NO: 247774 - protein, 25 aa, Homo sapiens
  Native (MAGC1_HUMAN)
EGCLSDEQGMSQNRLLILILSIIFI

SEQ ID NO: 247775 - protein, 15 aa, Homo sapiens
  Native (MAGC1_HUMAN)
EGEDSLSPLQIPQSP

SEQ ID NO: 247776 - protein, 16 aa, Homo sapiens
  Native (MAGC1_HUMAN)
EGEDSLSPLQIPQSPL

SEQ ID NO: 247777 - protein, 17 aa, Homo sapiens
  Native (MAGC1_HUMAN)
EGEDSLSPLQIPQSPLE

SEQ ID NO: 247778 - protein, 20 aa, Homo sapiens
  Native (MAGC1_HUMAN)
EGEDSLSPLQIPQSPLEGED

SEQ ID NO: 247779 - protein, 21 aa, Homo sapiens
  Native (MAGC1_HUMAN)
EGEDSLSPLQIPQSPLEGEDS

SEQ ID NO: 247780 - protein, 22 aa, Homo sapiens
  Native (MAGC1_HUMAN)
EGEDSLSPLQIPQSPLEGEDSL

SEQ ID NO: 247781 - protein, 23 aa, Homo sapiens
  Native (MAGC1_HUMAN)
EGEDSLSPLQIPQSPLEGEDSLS

SEQ ID NO: 247782 - protein, 24 aa, Homo sapiens
  Native (MAGC1_HUMAN)
EGEDSLSPLQIPQSPLEGEDSLSS

SEQ ID NO: 247783 - protein, 25 aa, Homo sapiens
  Native (MAGC1_HUMAN)
EGEDSLSPLQIPQSPLEGEDSLSSL

SEQ ID NO: 247784 - protein, 14 aa, Homo sapiens
  Native (MAGC1_HUMAN)
EGEDSLSSLHFPQS

SEQ ID NO: 247785 - protein, 15 aa, Homo sapiens
  Native (MAGC1_HUMAN)
EGEDSLSSLHFPQSP

SEQ ID NO: 247786 - protein, 16 aa, Homo sapiens
  Native (MAGC1_HUMAN)
EGEDSLSSLHFPQSPP

SEQ ID NO: 247787 - protein, 17 aa, Homo sapiens
  Native (MAGC1_HUMAN)
EGEDSLSSLHFPQSPPE

SEQ ID NO: 247788 - protein, 19 aa, Homo sapiens
  Native (MAGC1_HUMAN)
EGEDSLSSLHFPQSPPEWE

SEQ ID NO: 247789 - protein, 20 aa, Homo sapiens
  Native (MAGC1_HUMAN)
EGEDSLSSLHFPQSPPEWED

SEQ ID NO: 247790 - protein, 21 aa, Homo sapiens
  Native (MAGC1_HUMAN)
EGEDSLSSLHFPQSPPEWEDS

SEQ ID NO: 247791 - protein, 22 aa, Homo sapiens
  Native (MAGC1_HUMAN)
EGEDSLSSLHFPQSPPEWEDSL

SEQ ID NO: 247792 - protein, 23 aa, Homo sapiens
  Native (MAGC1_HUMAN)
EGEDSLSSLHFPQSPPEWEDSLS

SEQ ID NO: 247793 - protein, 24 aa, Homo sapiens
  Native (MAGC1_HUMAN)
EGEDSLSSLHFPQSPPEWEDSLSP

SEQ ID NO: 247794 - protein, 25 aa, Homo sapiens
  Native (MAGC1_HUMAN)
EGEDSLSSLHFPQSPPEWEDSLSPL

SEQ ID NO: 247795 - protein, 20 aa, Homo sapiens
  Native (MAGC1_HUMAN)
EGEDVQSPLQNPASSFFSSA

SEQ ID NO: 247796 - protein, 21 aa, Homo sapiens
  Native (MAGC1_HUMAN)
EGEDVQSPLQNPASSFFSSAL

SEQ ID NO: 247797 - protein, 22 aa, Homo sapiens
  Native (MAGC1_HUMAN)
EGEDVQSPLQNPASSFFSSALL

SEQ ID NO: 247798 - protein, 23 aa, Homo sapiens
  Native (MAGC1_HUMAN)
EGEDVQSPLQNPASSFFSSALLS

SEQ ID NO: 247799 - protein, 24 aa, Homo sapiens
  Native (MAGC1_HUMAN)
EGEDVQSPLQNPASSFFSSALLSI

SEQ ID NO: 247800 - protein, 25 aa, Homo sapiens
  Native (MAGC1_HUMAN)
EGEDVQSPLQNPASSFFSSALLSIF

SEQ ID NO: 247801 - protein, 14 aa, Homo sapiens
  Native (MAGC1_HUMAN)
EGENTHSPLQIVPS

SEQ ID NO: 247802 - protein, 15 aa, Homo sapiens
  Native (MAGC1_HUMAN)
EGENTHSPLQIVPSL

SEQ ID NO: 247803 - protein, 16 aa, Homo sapiens
  Native (MAGC1_HUMAN)
EGENTHSPLQIVPSLP

SEQ ID NO: 247804 - protein, 17 aa, Homo sapiens
  Native (MAGC1_HUMAN)
EGENTHSPLQIVPSLPE

SEQ ID NO: 247805 - protein, 18 aa, Homo sapiens
  Native (MAGC1_HUMAN)
EGENTHSPLQIVPSLPEW

SEQ ID NO: 247806 - protein, 19 aa, Homo sapiens
  Native (MAGC1_HUMAN)
EGENTHSPLQIVPSLPEWE

SEQ ID NO: 247807 - protein, 20 aa, Homo sapiens
  Native (MAGC1_HUMAN)
EGENTHSPLQIVPSLPEWED

SEQ ID NO: 247808 - protein, 21 aa, Homo sapiens
  Native (MAGC1_HUMAN)
EGENTHSPLQIVPSLPEWEDS

SEQ ID NO: 247809 - protein, 22 aa, Homo sapiens
  Native (MAGC1_HUMAN)
EGENTHSPLQIVPSLPEWEDSL

SEQ ID NO: 247810 - protein, 23 aa, Homo sapiens
  Native (MAGC1_HUMAN)
EGENTHSPLQIVPSLPEWEDSLS

SEQ ID NO: 247811 - protein, 24 aa, Homo sapiens
  Native (MAGC1_HUMAN)
EGENTHSPLQIVPSLPEWEDSLSP

SEQ ID NO: 247812 - protein, 25 aa, Homo sapiens
  Native (MAGC1_HUMAN)
EGENTHSPLQIVPSLPEWEDSLSPH

SEQ ID NO: 247813 - protein, 14 aa, Homo sapiens
  Native (MAGC1_HUMAN)
EGFAQSPLQIPVSP

SEQ ID NO: 247814 - protein, 15 aa, Homo sapiens
  Native (MAGC1_HUMAN)
EGFAQSPLQIPVSPS

SEQ ID NO: 247815 - protein, 16 aa, Homo sapiens
  Native (MAGC1_HUMAN)
EGFAQSPLQIPVSPSS

SEQ ID NO: 247816 - protein, 17 aa, Homo sapiens
  Native (MAGC1_HUMAN)
EGFAQSPLQIPVSPSSS

SEQ ID NO: 247817 - protein, 19 aa, Homo sapiens
  Native (MAGC1_HUMAN)
EGFAQSPLQIPVSPSSSST

SEQ ID NO: 247818 - protein, 20 aa, Homo sapiens
  Native (MAGC1_HUMAN)
EGFAQSPLQIPVSPSSSSTL

SEQ ID NO: 247819 - protein, 21 aa, Homo sapiens
  Native (MAGC1_HUMAN)
EGFAQSPLQIPVSPSSSSTLL

SEQ ID NO: 247820 - protein, 22 aa, Homo sapiens
  Native (MAGC1_HUMAN)
EGFAQSPLQIPVSPSSSSTLLS

SEQ ID NO: 247821 - protein, 23 aa, Homo sapiens
  Native (MAGC1_HUMAN)
EGFAQSPLQIPVSPSSSSTLLSL

SEQ ID NO: 247822 - protein, 24 aa, Homo sapiens
  Native (MAGC1_HUMAN)
EGFAQSPLQIPVSPSSSSTLLSLF

SEQ ID NO: 247823 - protein, 25 aa, Homo sapiens
  Native (MAGC1_HUMAN)
EGFAQSPLQIPVSPSSSSTLLSLFQ

SEQ ID NO: 247824 - protein, 14 aa, Homo sapiens
  Native (MAGC1_HUMAN)
EGFAQSSLQIPVSP

SEQ ID NO: 247825 - protein, 15 aa, Homo sapiens
  Native (MAGC1_HUMAN)
EGFAQSSLQIPVSPS

SEQ ID NO: 247826 - protein, 16 aa, Homo sapiens
  Native (MAGC1_HUMAN)
EGFAQSSLQIPVSPSF

SEQ ID NO: 247827 - protein, 17 aa, Homo sapiens
  Native (MAGC1_HUMAN)
EGFAQSSLQIPVSPSFS

SEQ ID NO: 247828 - protein, 19 aa, Homo sapiens
  Native (MAGC1_HUMAN)
EGFAQSSLQIPVSPSFSST

SEQ ID NO: 247829 - protein, 20 aa, Homo sapiens
  Native (MAGC1_HUMAN)
EGFAQSSLQIPVSPSFSSTL

SEQ ID NO: 247830 - protein, 21 aa, Homo sapiens
  Native (MAGC1_HUMAN)
EGFAQSSLQIPVSPSFSSTLV

SEQ ID NO: 247831 - protein, 22 aa, Homo sapiens
  Native (MAGC1_HUMAN)
EGFAQSSLQIPVSPSFSSTLVS

SEQ ID NO: 247832 - protein, 23 aa, Homo sapiens
  Native (MAGC1_HUMAN)
EGFAQSSLQIPVSPSFSSTLVSL

SEQ ID NO: 247833 - protein, 24 aa, Homo sapiens
  Native (MAGC1_HUMAN)
EGFAQSSLQIPVSPSFSSTLVSLF

SEQ ID NO: 247834 - protein, 25 aa, Homo sapiens
  Native (MAGC1_HUMAN)
EGFAQSSLQIPVSPSFSSTLVSLFQ

SEQ ID NO: 247835 - protein, 14 aa, Homo sapiens
  Native (MAGC1_HUMAN)
EGFPQSLLQIPMTS

SEQ ID NO: 247836 - protein, 15 aa, Homo sapiens
  Native (MAGC1_HUMAN)
EGFPQSLLQIPMTSS

SEQ ID NO: 247837 - protein, 16 aa, Homo sapiens
  Native (MAGC1_HUMAN)
EGFPQSLLQIPMTSSF

SEQ ID NO: 247838 - protein, 17 aa, Homo sapiens
  Native (MAGC1_HUMAN)
EGFPQSLLQIPMTSSFS

SEQ ID NO: 247839 - protein, 18 aa, Homo sapiens
  Native (MAGC1_HUMAN)
EGFPQSLLQIPMTSSFSS

SEQ ID NO: 247840 - protein, 19 aa, Homo sapiens
  Native (MAGC1_HUMAN)
EGFPQSLLQIPMTSSFSST

SEQ ID NO: 247841 - protein, 20 aa, Homo sapiens
  Native (MAGC1_HUMAN)
EGFPQSLLQIPMTSSFSSTL

SEQ ID NO: 247842 - protein, 21 aa, Homo sapiens
  Native (MAGC1_HUMAN)
EGFPQSLLQIPMTSSFSSTLL

SEQ ID NO: 247843 - protein, 22 aa, Homo sapiens
  Native (MAGC1_HUMAN)
EGFPQSLLQIPMTSSFSSTLLS

SEQ ID NO: 247844 - protein, 23 aa, Homo sapiens
  Native (MAGC1_HUMAN)
EGFPQSLLQIPMTSSFSSTLLSI

SEQ ID NO: 247845 - protein, 24 aa, Homo sapiens
  Native (MAGC1_HUMAN)
EGFPQSLLQIPMTSSFSSTLLSIF

SEQ ID NO: 247846 - protein, 25 aa, Homo sapiens
  Native (MAGC1_HUMAN)
EGFPQSLLQIPMTSSFSSTLLSIFQ

SEQ ID NO: 247847 - protein, 19 aa, Homo sapiens
  Native (MAGC1_HUMAN)
EGFPQSPLQIPGSPSFSST

SEQ ID NO: 247848 - protein, 20 aa, Homo sapiens
  Native (MAGC1_HUMAN)
EGFPQSPLQIPGSPSFSSTL

SEQ ID NO: 247849 - protein, 21 aa, Homo sapiens
  Native (MAGC1_HUMAN)
EGFPQSPLQIPGSPSFSSTLL

SEQ ID NO: 247850 - protein, 22 aa, Homo sapiens
  Native (MAGC1_HUMAN)
EGFPQSPLQIPGSPSFSSTLLS

SEQ ID NO: 247851 - protein, 23 aa, Homo sapiens
  Native (MAGC1_HUMAN)
EGFPQSPLQIPGSPSFSSTLLSL

SEQ ID NO: 247852 - protein, 24 aa, Homo sapiens
  Native (MAGC1_HUMAN)
EGFPQSPLQIPGSPSFSSTLLSLF

SEQ ID NO: 247853 - protein, 25 aa, Homo sapiens
  Native (MAGC1_HUMAN)
EGFPQSPLQIPGSPSFSSTLLSLFQ

SEQ ID NO: 247854 - protein, 17 aa, Homo sapiens
  Native (MAGC1_HUMAN)
EGFPQSPLQIPMTSSFS

SEQ ID NO: 247855 - protein, 19 aa, Homo sapiens
  Native (MAGC1_HUMAN)
EGFPQSPLQIPMTSSFSST

SEQ ID NO: 247856 - protein, 20 aa, Homo sapiens
  Native (MAGC1_HUMAN)
EGFPQSPLQIPMTSSFSSTL

SEQ ID NO: 247857 - protein, 21 aa, Homo sapiens
  Native (MAGC1_HUMAN)
EGFPQSPLQIPMTSSFSSTLL

SEQ ID NO: 247858 - protein, 22 aa, Homo sapiens
  Native (MAGC1_HUMAN)
EGFPQSPLQIPMTSSFSSTLLS

SEQ ID NO: 247859 - protein, 23 aa, Homo sapiens
  Native (MAGC1_HUMAN)
EGFPQSPLQIPMTSSFSSTLLSI

SEQ ID NO: 247860 - protein, 24 aa, Homo sapiens
  Native (MAGC1_HUMAN)
EGFPQSPLQIPMTSSFSSTLLSIL

SEQ ID NO: 247861 - protein, 25 aa, Homo sapiens
  Native (MAGC1_HUMAN)
EGFPQSPLQIPMTSSFSSTLLSILQ

SEQ ID NO: 247862 - protein, 20 aa, Homo sapiens
  Native (MAGC1_HUMAN)
EGFPQSPLQIPVSRSFSSTL

SEQ ID NO: 247863 - protein, 21 aa, Homo sapiens
  Native (MAGC1_HUMAN)
EGFPQSPLQIPVSRSFSSTLL

SEQ ID NO: 247864 - protein, 22 aa, Homo sapiens
  Native (MAGC1_HUMAN)
EGFPQSPLQIPVSRSFSSTLLS

SEQ ID NO: 247865 - protein, 23 aa, Homo sapiens
  Native (MAGC1_HUMAN)
EGFPQSPLQIPVSRSFSSTLLSI

SEQ ID NO: 247866 - protein, 24 aa, Homo sapiens
  Native (MAGC1_HUMAN)
EGFPQSPLQIPVSRSFSSTLLSIF

SEQ ID NO: 247867 - protein, 25 aa, Homo sapiens
  Native (MAGC1_HUMAN)
EGFPQSPLQIPVSRSFSSTLLSIFQ

SEQ ID NO: 247868 - protein, 20 aa, Homo sapiens
  Native (MAGC1_HUMAN)
EGFPQSPLQIPVSSSFSYTL

SEQ ID NO: 247869 - protein, 21 aa, Homo sapiens
  Native (MAGC1_HUMAN)
EGFPQSPLQIPVSSSFSYTLL

SEQ ID NO: 247870 - protein, 22 aa, Homo sapiens
  Native (MAGC1_HUMAN)
EGFPQSPLQIPVSSSFSYTLLS

SEQ ID NO: 247871 - protein, 23 aa, Homo sapiens
  Native (MAGC1_HUMAN)
EGFPQSPLQIPVSSSFSYTLLSL

SEQ ID NO: 247872 - protein, 24 aa, Homo sapiens
  Native (MAGC1_HUMAN)
EGFPQSPLQIPVSSSFSYTLLSLF

SEQ ID NO: 247873 - protein, 25 aa, Homo sapiens
  Native (MAGC1_HUMAN)
EGFPQSPLQIPVSSSFSYTLLSLFQ

SEQ ID NO: 247874 - protein, 19 aa, Homo sapiens
  Native (MAGC1_HUMAN)
EGFPQSPLQIPVSSSSSSS

SEQ ID NO: 247875 - protein, 20 aa, Homo sapiens
  Native (MAGC1_HUMAN)
EGFPQSPLQIPVSSSSSSST

SEQ ID NO: 247876 - protein, 21 aa, Homo sapiens
  Native (MAGC1_HUMAN)
EGFPQSPLQIPVSSSSSSSTL

SEQ ID NO: 247877 - protein, 22 aa, Homo sapiens
  Native (MAGC1_HUMAN)
EGFPQSPLQIPVSSSSSSSTLL

SEQ ID NO: 247878 - protein, 23 aa, Homo sapiens
  Native (MAGC1_HUMAN)
EGFPQSPLQIPVSSSSSSSTLLS

SEQ ID NO: 247879 - protein, 24 aa, Homo sapiens
  Native (MAGC1_HUMAN)
EGFPQSPLQIPVSSSSSSSTLLSL

SEQ ID NO: 247880 - protein, 25 aa, Homo sapiens
  Native (MAGC1_HUMAN)
EGFPQSPLQIPVSSSSSSSTLLSLF

SEQ ID NO: 247881 - protein, 19 aa, Homo sapiens
  Native (MAGC1_HUMAN)
EGFPQSPLQIPVSSSSSST

SEQ ID NO: 247882 - protein, 20 aa, Homo sapiens
  Native (MAGC1_HUMAN)
EGFPQSPLQIPVSSSSSSTL

SEQ ID NO: 247883 - protein, 21 aa, Homo sapiens
  Native (MAGC1_HUMAN)
EGFPQSPLQIPVSSSSSSTLL

SEQ ID NO: 247884 - protein, 22 aa, Homo sapiens
  Native (MAGC1_HUMAN)
EGFPQSPLQIPVSSSSSSTLLS

SEQ ID NO: 247885 - protein, 23 aa, Homo sapiens
  Native (MAGC1_HUMAN)
EGFPQSPLQIPVSSSSSSTLLSL

SEQ ID NO: 247886 - protein, 24 aa, Homo sapiens
  Native (MAGC1_HUMAN)
EGFPQSPLQIPVSSSSSSTLLSLF

SEQ ID NO: 247887 - protein, 25 aa, Homo sapiens
  Native (MAGC1_HUMAN)
EGFPQSPLQIPVSSSSSSTLLSLFQ

SEQ ID NO: 247888 - protein, 15 aa, Homo sapiens
  Native (MAGC1_HUMAN)
EGFPQSVLQIPVSAA

SEQ ID NO: 247889 - protein, 16 aa, Homo sapiens
  Native (MAGC1_HUMAN)
EGFPQSVLQIPVSAAS

SEQ ID NO: 247890 - protein, 17 aa, Homo sapiens
  Native (MAGC1_HUMAN)
EGFPQSVLQIPVSAASS

SEQ ID NO: 247891 - protein, 18 aa, Homo sapiens
  Native (MAGC1_HUMAN)
EGFPQSVLQIPVSAASSS

SEQ ID NO: 247892 - protein, 19 aa, Homo sapiens
  Native (MAGC1_HUMAN)
EGFPQSVLQIPVSAASSST

SEQ ID NO: 247893 - protein, 20 aa, Homo sapiens
  Native (MAGC1_HUMAN)
EGFPQSVLQIPVSAASSSTL

SEQ ID NO: 247894 - protein, 21 aa, Homo sapiens
  Native (MAGC1_HUMAN)
EGFPQSVLQIPVSAASSSTLV

SEQ ID NO: 247895 - protein, 22 aa, Homo sapiens
  Native (MAGC1_HUMAN)
EGFPQSVLQIPVSAASSSTLVS

SEQ ID NO: 247896 - protein, 23 aa, Homo sapiens
  Native (MAGC1_HUMAN)
EGFPQSVLQIPVSAASSSTLVSI

SEQ ID NO: 247897 - protein, 24 aa, Homo sapiens
  Native (MAGC1_HUMAN)
EGFPQSVLQIPVSAASSSTLVSIF

SEQ ID NO: 247898 - protein, 25 aa, Homo sapiens
  Native (MAGC1_HUMAN)
EGFPQSVLQIPVSAASSSTLVSIFQ

SEQ ID NO: 247899 - protein, 15 aa, Homo sapiens
  Native (MAGC1_HUMAN)
EGKDSLSPLEISQSP

SEQ ID NO: 247900 - protein, 20 aa, Homo sapiens
  Native (MAGC1_HUMAN)
EGKDSLSPLEISQSPPEGED

SEQ ID NO: 247901 - protein, 15 aa, Homo sapiens
  Native (MAGC1_HUMAN)
EGMHSQSPLQSPESA

SEQ ID NO: 247902 - protein, 20 aa, Homo sapiens
  Native (MAGC1_HUMAN)
EGPAQSPLQRPVSSFFSYTL

SEQ ID NO: 247903 - protein, 21 aa, Homo sapiens
  Native (MAGC1_HUMAN)
EGPAQSPLQRPVSSFFSYTLA

SEQ ID NO: 247904 - protein, 22 aa, Homo sapiens
  Native (MAGC1_HUMAN)
EGPAQSPLQRPVSSFFSYTLAS

SEQ ID NO: 247905 - protein, 23 aa, Homo sapiens
  Native (MAGC1_HUMAN)
EGPAQSPLQRPVSSFFSYTLASL

SEQ ID NO: 247906 - protein, 24 aa, Homo sapiens
  Native (MAGC1_HUMAN)
EGPAQSPLQRPVSSFFSYTLASLL

SEQ ID NO: 247907 - protein, 25 aa, Homo sapiens
  Native (MAGC1_HUMAN)
EGPAQSPLQRPVSSFFSYTLASLLQ

SEQ ID NO: 247908 - protein, 19 aa, Homo sapiens
  Native (MAGC1_HUMAN)
EGPAQSPLQSPVSSFPSST

SEQ ID NO: 247909 - protein, 20 aa, Homo sapiens
  Native (MAGC1_HUMAN)
EGPAQSPLQSPVSSFPSSTS

SEQ ID NO: 247910 - protein, 21 aa, Homo sapiens
  Native (MAGC1_HUMAN)
EGPAQSPLQSPVSSFPSSTSS

SEQ ID NO: 247911 - protein, 22 aa, Homo sapiens
  Native (MAGC1_HUMAN)
EGPAQSPLQSPVSSFPSSTSSS

SEQ ID NO: 247912 - protein, 23 aa, Homo sapiens
  Native (MAGC1_HUMAN)
EGPAQSPLQSPVSSFPSSTSSSL

SEQ ID NO: 247913 - protein, 24 aa, Homo sapiens
  Native (MAGC1_HUMAN)
EGPAQSPLQSPVSSFPSSTSSSLS

SEQ ID NO: 247914 - protein, 25 aa, Homo sapiens
  Native (MAGC1_HUMAN)
EGPAQSPLQSPVSSFPSSTSSSLSQ

SEQ ID NO: 247915 - protein, 13 aa, Homo sapiens
  Native (MAGC1_HUMAN)
EHFAFGEPRELLT

SEQ ID NO: 247916 - protein, 14 aa, Homo sapiens
  Native (MAGC1_HUMAN)
EHFAFGEPRELLTK

SEQ ID NO: 247917 - protein, 15 aa, Homo sapiens
  Native (MAGC1_HUMAN)
EHFAFGEPRELLTKV

SEQ ID NO: 247918 - protein, 16 aa, Homo sapiens
  Native (MAGC1_HUMAN)
EHFAFGEPRELLTKVW

SEQ ID NO: 247919 - protein, 17 aa, Homo sapiens
  Native (MAGC1_HUMAN)
EHFAFGEPRELLTKVWV

SEQ ID NO: 247920 - protein, 18 aa, Homo sapiens
  Native (MAGC1_HUMAN)
EHFAFGEPRELLTKVWVQ

SEQ ID NO: 247921 - protein, 19 aa, Homo sapiens
  Native (MAGC1_HUMAN)
EHFAFGEPRELLTKVWVQE

SEQ ID NO: 247922 - protein, 20 aa, Homo sapiens
  Native (MAGC1_HUMAN)
EHFAFGEPRELLTKVWVQEH

SEQ ID NO: 247923 - protein, 21 aa, Homo sapiens
  Native (MAGC1_HUMAN)
EHFAFGEPRELLTKVWVQEHY

SEQ ID NO: 247924 - protein, 22 aa, Homo sapiens
  Native (MAGC1_HUMAN)
EHFAFGEPRELLTKVWVQEHYL

SEQ ID NO: 247925 - protein, 23 aa, Homo sapiens
  Native (MAGC1_HUMAN)
EHFAFGEPRELLTKVWVQEHYLE

SEQ ID NO: 247926 - protein, 24 aa, Homo sapiens
  Native (MAGC1_HUMAN)
EHFAFGEPRELLTKVWVQEHYLEY

SEQ ID NO: 247927 - protein, 25 aa, Homo sapiens
  Native (MAGC1_HUMAN)
EHFAFGEPRELLTKVWVQEHYLEYR

SEQ ID NO: 247928 - protein, 15 aa, Homo sapiens
  Native (MAGC1_HUMAN)
EHYLEYREVPNSSPP

SEQ ID NO: 247929 - protein, 16 aa, Homo sapiens
  Native (MAGC1_HUMAN)
EHYLEYREVPNSSPPR

SEQ ID NO: 247930 - protein, 17 aa, Homo sapiens
  Native (MAGC1_HUMAN)
EHYLEYREVPNSSPPRY

SEQ ID NO: 247931 - protein, 20 aa, Homo sapiens
  Native (MAGC1_HUMAN)
EHYLEYREVPNSSPPRYEFL

SEQ ID NO: 247932 - protein, 25 aa, Homo sapiens
  Native (MAGC1_HUMAN)
EHYLEYREVPNSSPPRYEFLWGPRA

SEQ ID NO: 247933 - protein, 13 aa, Homo sapiens
  Native (MAGC1_HUMAN)
EILFGISLREVDP

SEQ ID NO: 247934 - protein, 14 aa, Homo sapiens
  Native (MAGC1_HUMAN)
EILFGISLREVDPD

SEQ ID NO: 247935 - protein, 15 aa, Homo sapiens
  Native (MAGC1_HUMAN)
EILFGISLREVDPDD

SEQ ID NO: 247936 - protein, 16 aa, Homo sapiens
  Native (MAGC1_HUMAN)
EILFGISLREVDPDDS

SEQ ID NO: 247937 - protein, 17 aa, Homo sapiens
  Native (MAGC1_HUMAN)
EILFGISLREVDPDDSY

SEQ ID NO: 247938 - protein, 18 aa, Homo sapiens
  Native (MAGC1_HUMAN)
EILFGISLREVDPDDSYV

SEQ ID NO: 247939 - protein, 19 aa, Homo sapiens
  Native (MAGC1_HUMAN)
EILFGISLREVDPDDSYVF

SEQ ID NO: 247940 - protein, 20 aa, Homo sapiens
  Native (MAGC1_HUMAN)
EILFGISLREVDPDDSYVFV

SEQ ID NO: 247941 - protein, 21 aa, Homo sapiens
  Native (MAGC1_HUMAN)
EILFGISLREVDPDDSYVFVN

SEQ ID NO: 247942 - protein, 22 aa, Homo sapiens
  Native (MAGC1_HUMAN)
EILFGISLREVDPDDSYVFVNT

SEQ ID NO: 247943 - protein, 23 aa, Homo sapiens
  Native (MAGC1_HUMAN)
EILFGISLREVDPDDSYVFVNTL

SEQ ID NO: 247944 - protein, 24 aa, Homo sapiens
  Native (MAGC1_HUMAN)
EILFGISLREVDPDDSYVFVNTLD

SEQ ID NO: 247945 - protein, 25 aa, Homo sapiens
  Native (MAGC1_HUMAN)
EILFGISLREVDPDDSYVFVNTLDL

SEQ ID NO: 247946 - protein, 13 aa, Homo sapiens
  Native (MAGC1_HUMAN)
EKVDELARFLLLK

SEQ ID NO: 247947 - protein, 14 aa, Homo sapiens
  Native (MAGC1_HUMAN)
EKVDELARFLLLKY

SEQ ID NO: 247948 - protein, 16 aa, Homo sapiens
  Native (MAGC1_HUMAN)
EKVDELARFLLLKYQV

SEQ ID NO: 247949 - protein, 17 aa, Homo sapiens
  Native (MAGC1_HUMAN)
EKVDELARFLLLKYQVK

SEQ ID NO: 247950 - protein, 18 aa, Homo sapiens
  Native (MAGC1_HUMAN)
EKVDELARFLLLKYQVKQ

SEQ ID NO: 247951 - protein, 19 aa, Homo sapiens
  Native (MAGC1_HUMAN)
EKVDELARFLLLKYQVKQP

SEQ ID NO: 247952 - protein, 20 aa, Homo sapiens
  Native (MAGC1_HUMAN)
EKVDELARFLLLKYQVKQPI

SEQ ID NO: 247953 - protein, 21 aa, Homo sapiens
  Native (MAGC1_HUMAN)
EKVDELARFLLLKYQVKQPIT

SEQ ID NO: 247954 - protein, 22 aa, Homo sapiens
  Native (MAGC1_HUMAN)
EKVDELARFLLLKYQVKQPITK

SEQ ID NO: 247955 - protein, 23 aa, Homo sapiens
  Native (MAGC1_HUMAN)
EKVDELARFLLLKYQVKQPITKA

SEQ ID NO: 247956 - protein, 24 aa, Homo sapiens
  Native (MAGC1_HUMAN)
EKVDELARFLLLKYQVKQPITKAE

SEQ ID NO: 247957 - protein, 25 aa, Homo sapiens
  Native (MAGC1_HUMAN)
EKVDELARFLLLKYQVKQPITKAEM

SEQ ID NO: 247958 - protein, 13 aa, Homo sapiens
  Native (MAGC1_HUMAN)
ELARFLLLKYQVK

SEQ ID NO: 247959 - protein, 14 aa, Homo sapiens
  Native (MAGC1_HUMAN)
ELARFLLLKYQVKQ

SEQ ID NO: 247960 - protein, 15 aa, Homo sapiens
  Native (MAGC1_HUMAN)
ELARFLLLKYQVKQP

SEQ ID NO: 247961 - protein, 16 aa, Homo sapiens
  Native (MAGC1_HUMAN)
ELARFLLLKYQVKQPI

SEQ ID NO: 247962 - protein, 17 aa, Homo sapiens
  Native (MAGC1_HUMAN)
ELARFLLLKYQVKQPIT

SEQ ID NO: 247963 - protein, 18 aa, Homo sapiens
  Native (MAGC1_HUMAN)
ELARFLLLKYQVKQPITK

SEQ ID NO: 247964 - protein, 19 aa, Homo sapiens
  Native (MAGC1_HUMAN)
ELARFLLLKYQVKQPITKA

SEQ ID NO: 247965 - protein, 20 aa, Homo sapiens
  Native (MAGC1_HUMAN)
ELARFLLLKYQVKQPITKAE

SEQ ID NO: 247966 - protein, 21 aa, Homo sapiens
  Native (MAGC1_HUMAN)
ELARFLLLKYQVKQPITKAEM

SEQ ID NO: 247967 - protein, 22 aa, Homo sapiens
  Native (MAGC1_HUMAN)
ELARFLLLKYQVKQPITKAEML

SEQ ID NO: 247968 - protein, 23 aa, Homo sapiens
  Native (MAGC1_HUMAN)
ELARFLLLKYQVKQPITKAEMLT

SEQ ID NO: 247969 - protein, 24 aa, Homo sapiens
  Native (MAGC1_HUMAN)
ELARFLLLKYQVKQPITKAEMLTN

SEQ ID NO: 247970 - protein, 25 aa, Homo sapiens
  Native (MAGC1_HUMAN)
ELARFLLLKYQVKQPITKAEMLTNV

SEQ ID NO: 247971 - protein, 13 aa, Homo sapiens
  Native (MAGC1_HUMAN)
ELLTKVWVQEHYL

SEQ ID NO: 247972 - protein, 14 aa, Homo sapiens
  Native (MAGC1_HUMAN)
ELLTKVWVQEHYLE

SEQ ID NO: 247973 - protein, 15 aa, Homo sapiens
  Native (MAGC1_HUMAN)
ELLTKVWVQEHYLEY

SEQ ID NO: 247974 - protein, 16 aa, Homo sapiens
  Native (MAGC1_HUMAN)
ELLTKVWVQEHYLEYR

SEQ ID NO: 247975 - protein, 17 aa, Homo sapiens
  Native (MAGC1_HUMAN)
ELLTKVWVQEHYLEYRE

SEQ ID NO: 247976 - protein, 18 aa, Homo sapiens
  Native (MAGC1_HUMAN)
ELLTKVWVQEHYLEYREV

SEQ ID NO: 247977 - protein, 19 aa, Homo sapiens
  Native (MAGC1_HUMAN)
ELLTKVWVQEHYLEYREVP

SEQ ID NO: 247978 - protein, 20 aa, Homo sapiens
  Native (MAGC1_HUMAN)
ELLTKVWVQEHYLEYREVPN

SEQ ID NO: 247979 - protein, 21 aa, Homo sapiens
  Native (MAGC1_HUMAN)
ELLTKVWVQEHYLEYREVPNS

SEQ ID NO: 247980 - protein, 22 aa, Homo sapiens
  Native (MAGC1_HUMAN)
ELLTKVWVQEHYLEYREVPNSS

SEQ ID NO: 247981 - protein, 23 aa, Homo sapiens
  Native (MAGC1_HUMAN)
ELLTKVWVQEHYLEYREVPNSSP

SEQ ID NO: 247982 - protein, 24 aa, Homo sapiens
  Native (MAGC1_HUMAN)
ELLTKVWVQEHYLEYREVPNSSPP

SEQ ID NO: 247983 - protein, 25 aa, Homo sapiens
  Native (MAGC1_HUMAN)
ELLTKVWVQEHYLEYREVPNSSPPR

SEQ ID NO: 247984 - protein, 13 aa, Homo sapiens
  Native (MAGC1_HUMAN)
EMLTNVISRYTGY

SEQ ID NO: 247985 - protein, 14 aa, Homo sapiens
  Native (MAGC1_HUMAN)
EMLTNVISRYTGYF

SEQ ID NO: 247986 - protein, 15 aa, Homo sapiens
  Native (MAGC1_HUMAN)
EMLTNVISRYTGYFP

SEQ ID NO: 247987 - protein, 16 aa, Homo sapiens
  Native (MAGC1_HUMAN)
EMLTNVISRYTGYFPV

SEQ ID NO: 247988 - protein, 17 aa, Homo sapiens
  Native (MAGC1_HUMAN)
EMLTNVISRYTGYFPVI

SEQ ID NO: 247989 - protein, 18 aa, Homo sapiens
  Native (MAGC1_HUMAN)
EMLTNVISRYTGYFPVIF

SEQ ID NO: 247990 - protein, 19 aa, Homo sapiens
  Native (MAGC1_HUMAN)
EMLTNVISRYTGYFPVIFR

SEQ ID NO: 247991 - protein, 20 aa, Homo sapiens
  Native (MAGC1_HUMAN)
EMLTNVISRYTGYFPVIFRK

SEQ ID NO: 247992 - protein, 21 aa, Homo sapiens
  Native (MAGC1_HUMAN)
EMLTNVISRYTGYFPVIFRKA

SEQ ID NO: 247993 - protein, 22 aa, Homo sapiens
  Native (MAGC1_HUMAN)
EMLTNVISRYTGYFPVIFRKAR

SEQ ID NO: 247994 - protein, 23 aa, Homo sapiens
  Native (MAGC1_HUMAN)
EMLTNVISRYTGYFPVIFRKARE

SEQ ID NO: 247995 - protein, 24 aa, Homo sapiens
  Native (MAGC1_HUMAN)
EMLTNVISRYTGYFPVIFRKAREF

SEQ ID NO: 247996 - protein, 25 aa, Homo sapiens
  Native (MAGC1_HUMAN)
EMLTNVISRYTGYFPVIFRKAREFI

SEQ ID NO: 247997 - protein, 14 aa, Homo sapiens
  Native (MAGC1_HUMAN)
ENTHSPLQIVPSLP

SEQ ID NO: 247998 - protein, 15 aa, Homo sapiens
  Native (MAGC1_HUMAN)
ENTHSPLQIVPSLPE

SEQ ID NO: 247999 - protein, 16 aa, Homo sapiens
  Native (MAGC1_HUMAN)
ENTHSPLQIVPSLPEW

SEQ ID NO: 248000 - protein, 17 aa, Homo sapiens
  Native (MAGC1_HUMAN)
ENTHSPLQIVPSLPEWE

SEQ ID NO: 248001 - protein, 18 aa, Homo sapiens
  Native (MAGC1_HUMAN)
ENTHSPLQIVPSLPEWED

SEQ ID NO: 248002 - protein, 19 aa, Homo sapiens
  Native (MAGC1_HUMAN)
ENTHSPLQIVPSLPEWEDS

SEQ ID NO: 248003 - protein, 20 aa, Homo sapiens
  Native (MAGC1_HUMAN)
ENTHSPLQIVPSLPEWEDSL

SEQ ID NO: 248004 - protein, 21 aa, Homo sapiens
  Native (MAGC1_HUMAN)
ENTHSPLQIVPSLPEWEDSLS

SEQ ID NO: 248005 - protein, 22 aa, Homo sapiens
  Native (MAGC1_HUMAN)
ENTHSPLQIVPSLPEWEDSLSP

SEQ ID NO: 248006 - protein, 23 aa, Homo sapiens
  Native (MAGC1_HUMAN)
ENTHSPLQIVPSLPEWEDSLSPH

SEQ ID NO: 248007 - protein, 24 aa, Homo sapiens
  Native (MAGC1_HUMAN)
ENTHSPLQIVPSLPEWEDSLSPHY

SEQ ID NO: 248008 - protein, 25 aa, Homo sapiens
  Native (MAGC1_HUMAN)
ENTHSPLQIVPSLPEWEDSLSPHYF

SEQ ID NO: 248009 - protein, 13 aa, Homo sapiens
  Native (MAGC1_HUMAN)
EPLFTYTLDEKVD

SEQ ID NO: 248010 - protein, 14 aa, Homo sapiens
  Native (MAGC1_HUMAN)
EPLFTYTLDEKVDE

SEQ ID NO: 248011 - protein, 15 aa, Homo sapiens
  Native (MAGC1_HUMAN)
EPLFTYTLDEKVDEL

SEQ ID NO: 248012 - protein, 16 aa, Homo sapiens
  Native (MAGC1_HUMAN)
EPLFTYTLDEKVDELA

SEQ ID NO: 248013 - protein, 17 aa, Homo sapiens
  Native (MAGC1_HUMAN)
EPLFTYTLDEKVDELAR

SEQ ID NO: 248014 - protein, 18 aa, Homo sapiens
  Native (MAGC1_HUMAN)
EPLFTYTLDEKVDELARF

SEQ ID NO: 248015 - protein, 19 aa, Homo sapiens
  Native (MAGC1_HUMAN)
EPLFTYTLDEKVDELARFL

SEQ ID NO: 248016 - protein, 20 aa, Homo sapiens
  Native (MAGC1_HUMAN)
EPLFTYTLDEKVDELARFLL

SEQ ID NO: 248017 - protein, 21 aa, Homo sapiens
  Native (MAGC1_HUMAN)
EPLFTYTLDEKVDELARFLLL

SEQ ID NO: 248018 - protein, 22 aa, Homo sapiens
  Native (MAGC1_HUMAN)
EPLFTYTLDEKVDELARFLLLK

SEQ ID NO: 248019 - protein, 23 aa, Homo sapiens
  Native (MAGC1_HUMAN)
EPLFTYTLDEKVDELARFLLLKY

SEQ ID NO: 248020 - protein, 24 aa, Homo sapiens
  Native (MAGC1_HUMAN)
EPLFTYTLDEKVDELARFLLLKYQ

SEQ ID NO: 248021 - protein, 25 aa, Homo sapiens
  Native (MAGC1_HUMAN)
EPLFTYTLDEKVDELARFLLLKYQV

SEQ ID NO: 248022 - protein, 14 aa, Homo sapiens
  Native (MAGC1_HUMAN)
EPRELLTKVWVQEH

SEQ ID NO: 248023 - protein, 15 aa, Homo sapiens
  Native (MAGC1_HUMAN)
EPRELLTKVWVQEHY

SEQ ID NO: 248024 - protein, 16 aa, Homo sapiens
  Native (MAGC1_HUMAN)
EPRELLTKVWVQEHYL

SEQ ID NO: 248025 - protein, 17 aa, Homo sapiens
  Native (MAGC1_HUMAN)
EPRELLTKVWVQEHYLE

SEQ ID NO: 248026 - protein, 18 aa, Homo sapiens
  Native (MAGC1_HUMAN)
EPRELLTKVWVQEHYLEY

SEQ ID NO: 248027 - protein, 19 aa, Homo sapiens
  Native (MAGC1_HUMAN)
EPRELLTKVWVQEHYLEYR

SEQ ID NO: 248028 - protein, 20 aa, Homo sapiens
  Native (MAGC1_HUMAN)
EPRELLTKVWVQEHYLEYRE

SEQ ID NO: 248029 - protein, 21 aa, Homo sapiens
  Native (MAGC1_HUMAN)
EPRELLTKVWVQEHYLEYREV

SEQ ID NO: 248030 - protein, 22 aa, Homo sapiens
  Native (MAGC1_HUMAN)
EPRELLTKVWVQEHYLEYREVP

SEQ ID NO: 248031 - protein, 23 aa, Homo sapiens
  Native (MAGC1_HUMAN)
EPRELLTKVWVQEHYLEYREVPN

SEQ ID NO: 248032 - protein, 24 aa, Homo sapiens
  Native (MAGC1_HUMAN)
EPRELLTKVWVQEHYLEYREVPNS

SEQ ID NO: 248033 - protein, 25 aa, Homo sapiens
  Native (MAGC1_HUMAN)
EPRELLTKVWVQEHYLEYREVPNSS

SEQ ID NO: 248034 - protein, 13 aa, Homo sapiens
  Native (MAGC1_HUMAN)
EQGMSQNRLLILI

SEQ ID NO: 248035 - protein, 14 aa, Homo sapiens
  Native (MAGC1_HUMAN)
EQGMSQNRLLILIL

SEQ ID NO: 248036 - protein, 15 aa, Homo sapiens
  Native (MAGC1_HUMAN)
EQGMSQNRLLILILS

SEQ ID NO: 248037 - protein, 16 aa, Homo sapiens
  Native (MAGC1_HUMAN)
EQGMSQNRLLILILSI

SEQ ID NO: 248038 - protein, 17 aa, Homo sapiens
  Native (MAGC1_HUMAN)
EQGMSQNRLLILILSII

SEQ ID NO: 248039 - protein, 18 aa, Homo sapiens
  Native (MAGC1_HUMAN)
EQGMSQNRLLILILSIIF

SEQ ID NO: 248040 - protein, 19 aa, Homo sapiens
  Native (MAGC1_HUMAN)
EQGMSQNRLLILILSIIFI

SEQ ID NO: 248041 - protein, 20 aa, Homo sapiens
  Native (MAGC1_HUMAN)
EQGMSQNRLLILILSIIFIK

SEQ ID NO: 248042 - protein, 21 aa, Homo sapiens
  Native (MAGC1_HUMAN)
EQGMSQNRLLILILSIIFIKG

SEQ ID NO: 248043 - protein, 22 aa, Homo sapiens
  Native (MAGC1_HUMAN)
EQGMSQNRLLILILSIIFIKGT

SEQ ID NO: 248044 - protein, 23 aa, Homo sapiens
  Native (MAGC1_HUMAN)
EQGMSQNRLLILILSIIFIKGTY

SEQ ID NO: 248045 - protein, 24 aa, Homo sapiens
  Native (MAGC1_HUMAN)
EQGMSQNRLLILILSIIFIKGTYA

SEQ ID NO: 248046 - protein, 25 aa, Homo sapiens
  Native (MAGC1_HUMAN)
EQGMSQNRLLILILSIIFIKGTYAS

SEQ ID NO: 248047 - protein, 23 aa, Homo sapiens
  Native (MAGC1_HUMAN)
ERAQAIIDTTDDSTATESASSSV

SEQ ID NO: 248048 - protein, 24 aa, Homo sapiens
  Native (MAGC1_HUMAN)
ERAQAIIDTTDDSTATESASSSVM

SEQ ID NO: 248049 - protein, 25 aa, Homo sapiens
  Native (MAGC1_HUMAN)
ERAQAIIDTTDDSTATESASSSVMS

SEQ ID NO: 248050 - protein, 15 aa, Homo sapiens
  Native (MAGC1_HUMAN)
ERTHSTFEGFPQSLL

SEQ ID NO: 248051 - protein, 16 aa, Homo sapiens
  Native (MAGC1_HUMAN)
ERTHSTFEGFPQSLLQ

SEQ ID NO: 248052 - protein, 17 aa, Homo sapiens
  Native (MAGC1_HUMAN)
ERTHSTFEGFPQSLLQI

SEQ ID NO: 248053 - protein, 18 aa, Homo sapiens
  Native (MAGC1_HUMAN)
ERTHSTFEGFPQSLLQIP

SEQ ID NO: 248054 - protein, 19 aa, Homo sapiens
  Native (MAGC1_HUMAN)
ERTHSTFEGFPQSLLQIPM

SEQ ID NO: 248055 - protein, 20 aa, Homo sapiens
  Native (MAGC1_HUMAN)
ERTHSTFEGFPQSLLQIPMT

SEQ ID NO: 248056 - protein, 21 aa, Homo sapiens
  Native (MAGC1_HUMAN)
ERTHSTFEGFPQSLLQIPMTS

SEQ ID NO: 248057 - protein, 22 aa, Homo sapiens
  Native (MAGC1_HUMAN)
ERTHSTFEGFPQSLLQIPMTSS

SEQ ID NO: 248058 - protein, 23 aa, Homo sapiens
  Native (MAGC1_HUMAN)
ERTHSTFEGFPQSLLQIPMTSSF

SEQ ID NO: 248059 - protein, 24 aa, Homo sapiens
  Native (MAGC1_HUMAN)
ERTHSTFEGFPQSLLQIPMTSSFS

SEQ ID NO: 248060 - protein, 25 aa, Homo sapiens
  Native (MAGC1_HUMAN)
ERTHSTFEGFPQSLLQIPMTSSFSS

SEQ ID NO: 248061 - protein, 15 aa, Homo sapiens
  Native (MAGC1_HUMAN)
ERTHSTFEGFPQSPL

SEQ ID NO: 248062 - protein, 16 aa, Homo sapiens
  Native (MAGC1_HUMAN)
ERTHSTFEGFPQSPLQ

SEQ ID NO: 248063 - protein, 17 aa, Homo sapiens
  Native (MAGC1_HUMAN)
ERTHSTFEGFPQSPLQI

SEQ ID NO: 248064 - protein, 18 aa, Homo sapiens
  Native (MAGC1_HUMAN)
ERTHSTFEGFPQSPLQIP

SEQ ID NO: 248065 - protein, 19 aa, Homo sapiens
  Native (MAGC1_HUMAN)
ERTHSTFEGFPQSPLQIPM

SEQ ID NO: 248066 - protein, 20 aa, Homo sapiens
  Native (MAGC1_HUMAN)
ERTHSTFEGFPQSPLQIPMT

SEQ ID NO: 248067 - protein, 21 aa, Homo sapiens
  Native (MAGC1_HUMAN)
ERTHSTFEGFPQSPLQIPMTS

SEQ ID NO: 248068 - protein, 22 aa, Homo sapiens
  Native (MAGC1_HUMAN)
ERTHSTFEGFPQSPLQIPMTSS

SEQ ID NO: 248069 - protein, 23 aa, Homo sapiens
  Native (MAGC1_HUMAN)
ERTHSTFEGFPQSPLQIPMTSSF

SEQ ID NO: 248070 - protein, 24 aa, Homo sapiens
  Native (MAGC1_HUMAN)
ERTHSTFEGFPQSPLQIPMTSSFS

SEQ ID NO: 248071 - protein, 25 aa, Homo sapiens
  Native (MAGC1_HUMAN)
ERTHSTFEGFPQSPLQIPMTSSFSS

SEQ ID NO: 248072 - protein, 19 aa, Homo sapiens
  Native (MAGC1_HUMAN)
ERTHSTFEGFPQSPLQIPV

SEQ ID NO: 248073 - protein, 20 aa, Homo sapiens
  Native (MAGC1_HUMAN)
ERTHSTFEGFPQSPLQIPVS

SEQ ID NO: 248074 - protein, 21 aa, Homo sapiens
  Native (MAGC1_HUMAN)
ERTHSTFEGFPQSPLQIPVSS

SEQ ID NO: 248075 - protein, 22 aa, Homo sapiens
  Native (MAGC1_HUMAN)
ERTHSTFEGFPQSPLQIPVSSS

SEQ ID NO: 248076 - protein, 23 aa, Homo sapiens
  Native (MAGC1_HUMAN)
ERTHSTFEGFPQSPLQIPVSSSS

SEQ ID NO: 248077 - protein, 24 aa, Homo sapiens
  Native (MAGC1_HUMAN)
ERTHSTFEGFPQSPLQIPVSSSSS

SEQ ID NO: 248078 - protein, 25 aa, Homo sapiens
  Native (MAGC1_HUMAN)
ERTHSTFEGFPQSPLQIPVSSSSSS

SEQ ID NO: 248079 - protein, 15 aa, Homo sapiens
  Native (MAGC1_HUMAN)
ERTQSTFEGFAQSPL

SEQ ID NO: 248080 - protein, 16 aa, Homo sapiens
  Native (MAGC1_HUMAN)
ERTQSTFEGFAQSPLQ

SEQ ID NO: 248081 - protein, 17 aa, Homo sapiens
  Native (MAGC1_HUMAN)
ERTQSTFEGFAQSPLQI

SEQ ID NO: 248082 - protein, 18 aa, Homo sapiens
  Native (MAGC1_HUMAN)
ERTQSTFEGFAQSPLQIP

SEQ ID NO: 248083 - protein, 19 aa, Homo sapiens
  Native (MAGC1_HUMAN)
ERTQSTFEGFAQSPLQIPV

SEQ ID NO: 248084 - protein, 20 aa, Homo sapiens
  Native (MAGC1_HUMAN)
ERTQSTFEGFAQSPLQIPVS

SEQ ID NO: 248085 - protein, 21 aa, Homo sapiens
  Native (MAGC1_HUMAN)
ERTQSTFEGFAQSPLQIPVSP

SEQ ID NO: 248086 - protein, 22 aa, Homo sapiens
  Native (MAGC1_HUMAN)
ERTQSTFEGFAQSPLQIPVSPS

SEQ ID NO: 248087 - protein, 23 aa, Homo sapiens
  Native (MAGC1_HUMAN)
ERTQSTFEGFAQSPLQIPVSPSS

SEQ ID NO: 248088 - protein, 24 aa, Homo sapiens
  Native (MAGC1_HUMAN)
ERTQSTFEGFAQSPLQIPVSPSSS

SEQ ID NO: 248089 - protein, 25 aa, Homo sapiens
  Native (MAGC1_HUMAN)
ERTQSTFEGFAQSPLQIPVSPSSSS

SEQ ID NO: 248090 - protein, 14 aa, Homo sapiens
  Native (MAGC1_HUMAN)
ERTQSTFEGFAQSS

SEQ ID NO: 248091 - protein, 15 aa, Homo sapiens
  Native (MAGC1_HUMAN)
ERTQSTFEGFAQSSL

SEQ ID NO: 248092 - protein, 16 aa, Homo sapiens
  Native (MAGC1_HUMAN)
ERTQSTFEGFAQSSLQ

SEQ ID NO: 248093 - protein, 17 aa, Homo sapiens
  Native (MAGC1_HUMAN)
ERTQSTFEGFAQSSLQI

SEQ ID NO: 248094 - protein, 18 aa, Homo sapiens
  Native (MAGC1_HUMAN)
ERTQSTFEGFAQSSLQIP

SEQ ID NO: 248095 - protein, 19 aa, Homo sapiens
  Native (MAGC1_HUMAN)
ERTQSTFEGFAQSSLQIPV

SEQ ID NO: 248096 - protein, 20 aa, Homo sapiens
  Native (MAGC1_HUMAN)
ERTQSTFEGFAQSSLQIPVS

SEQ ID NO: 248097 - protein, 21 aa, Homo sapiens
  Native (MAGC1_HUMAN)
ERTQSTFEGFAQSSLQIPVSP

SEQ ID NO: 248098 - protein, 22 aa, Homo sapiens
  Native (MAGC1_HUMAN)
ERTQSTFEGFAQSSLQIPVSPS

SEQ ID NO: 248099 - protein, 23 aa, Homo sapiens
  Native (MAGC1_HUMAN)
ERTQSTFEGFAQSSLQIPVSPSF

SEQ ID NO: 248100 - protein, 24 aa, Homo sapiens
  Native (MAGC1_HUMAN)
ERTQSTFEGFAQSSLQIPVSPSFS

SEQ ID NO: 248101 - protein, 25 aa, Homo sapiens
  Native (MAGC1_HUMAN)
ERTQSTFEGFAQSSLQIPVSPSFSS

SEQ ID NO: 248102 - protein, 15 aa, Homo sapiens
  Native (MAGC1_HUMAN)
ERTQSTFEGFPQSPL

SEQ ID NO: 248103 - protein, 16 aa, Homo sapiens
  Native (MAGC1_HUMAN)
ERTQSTFEGFPQSPLQ

SEQ ID NO: 248104 - protein, 17 aa, Homo sapiens
  Native (MAGC1_HUMAN)
ERTQSTFEGFPQSPLQI

SEQ ID NO: 248105 - protein, 18 aa, Homo sapiens
  Native (MAGC1_HUMAN)
ERTQSTFEGFPQSPLQIP

SEQ ID NO: 248106 - protein, 19 aa, Homo sapiens
  Native (MAGC1_HUMAN)
ERTQSTFEGFPQSPLQIPV

SEQ ID NO: 248107 - protein, 20 aa, Homo sapiens
  Native (MAGC1_HUMAN)
ERTQSTFEGFPQSPLQIPVS

SEQ ID NO: 248108 - protein, 21 aa, Homo sapiens
  Native (MAGC1_HUMAN)
ERTQSTFEGFPQSPLQIPVSS

SEQ ID NO: 248109 - protein, 22 aa, Homo sapiens
  Native (MAGC1_HUMAN)
ERTQSTFEGFPQSPLQIPVSSS

SEQ ID NO: 248110 - protein, 23 aa, Homo sapiens
  Native (MAGC1_HUMAN)
ERTQSTFEGFPQSPLQIPVSSSS

SEQ ID NO: 248111 - protein, 24 aa, Homo sapiens
  Native (MAGC1_HUMAN)
ERTQSTFEGFPQSPLQIPVSSSSS

SEQ ID NO: 248112 - protein, 25 aa, Homo sapiens
  Native (MAGC1_HUMAN)
ERTQSTFEGFPQSPLQIPVSSSSSS

SEQ ID NO: 248113 - protein, 20 aa, Homo sapiens
  Native (MAGC1_HUMAN)
ESAPEGEDSLSPLQIPQSPL

SEQ ID NO: 248114 - protein, 21 aa, Homo sapiens
  Native (MAGC1_HUMAN)
ESAPEGEDSLSPLQIPQSPLE

SEQ ID NO: 248115 - protein, 22 aa, Homo sapiens
  Native (MAGC1_HUMAN)
ESAPEGEDSLSPLQIPQSPLEG

SEQ ID NO: 248116 - protein, 23 aa, Homo sapiens
  Native (MAGC1_HUMAN)
ESAPEGEDSLSPLQIPQSPLEGE

SEQ ID NO: 248117 - protein, 24 aa, Homo sapiens
  Native (MAGC1_HUMAN)
ESAPEGEDSLSPLQIPQSPLEGED

SEQ ID NO: 248118 - protein, 25 aa, Homo sapiens
  Native (MAGC1_HUMAN)
ESAPEGEDSLSPLQIPQSPLEGEDS

SEQ ID NO: 248119 - protein, 15 aa, Homo sapiens
  Native (MAGC1_HUMAN)
ESAQSAFEGFPQSPL

SEQ ID NO: 248120 - protein, 16 aa, Homo sapiens
  Native (MAGC1_HUMAN)
ESAQSAFEGFPQSPLQ

SEQ ID NO: 248121 - protein, 17 aa, Homo sapiens
  Native (MAGC1_HUMAN)
ESAQSAFEGFPQSPLQI

SEQ ID NO: 248122 - protein, 19 aa, Homo sapiens
  Native (MAGC1_HUMAN)
ESAQSAFEGFPQSPLQIPV

SEQ ID NO: 248123 - protein, 20 aa, Homo sapiens
  Native (MAGC1_HUMAN)
ESAQSAFEGFPQSPLQIPVS

SEQ ID NO: 248124 - protein, 21 aa, Homo sapiens
  Native (MAGC1_HUMAN)
ESAQSAFEGFPQSPLQIPVSS

SEQ ID NO: 248125 - protein, 22 aa, Homo sapiens
  Native (MAGC1_HUMAN)
ESAQSAFEGFPQSPLQIPVSSS

SEQ ID NO: 248126 - protein, 23 aa, Homo sapiens
  Native (MAGC1_HUMAN)
ESAQSAFEGFPQSPLQIPVSSSF

SEQ ID NO: 248127 - protein, 24 aa, Homo sapiens
  Native (MAGC1_HUMAN)
ESAQSAFEGFPQSPLQIPVSSSFS

SEQ ID NO: 248128 - protein, 25 aa, Homo sapiens
  Native (MAGC1_HUMAN)
ESAQSAFEGFPQSPLQIPVSSSFSY

SEQ ID NO: 248129 - protein, 15 aa, Homo sapiens
  Native (MAGC1_HUMAN)
ESAQSTFEGFPQSPL

SEQ ID NO: 248130 - protein, 16 aa, Homo sapiens
  Native (MAGC1_HUMAN)
ESAQSTFEGFPQSPLQ

SEQ ID NO: 248131 - protein, 17 aa, Homo sapiens
  Native (MAGC1_HUMAN)
ESAQSTFEGFPQSPLQI

SEQ ID NO: 248132 - protein, 19 aa, Homo sapiens
  Native (MAGC1_HUMAN)
ESAQSTFEGFPQSPLQIPG

SEQ ID NO: 248133 - protein, 20 aa, Homo sapiens
  Native (MAGC1_HUMAN)
ESAQSTFEGFPQSPLQIPGS

SEQ ID NO: 248134 - protein, 21 aa, Homo sapiens
  Native (MAGC1_HUMAN)
ESAQSTFEGFPQSPLQIPGSP

SEQ ID NO: 248135 - protein, 22 aa, Homo sapiens
  Native (MAGC1_HUMAN)
ESAQSTFEGFPQSPLQIPGSPS

SEQ ID NO: 248136 - protein, 23 aa, Homo sapiens
  Native (MAGC1_HUMAN)
ESAQSTFEGFPQSPLQIPGSPSF

SEQ ID NO: 248137 - protein, 24 aa, Homo sapiens
  Native (MAGC1_HUMAN)
ESAQSTFEGFPQSPLQIPGSPSFS

SEQ ID NO: 248138 - protein, 25 aa, Homo sapiens
  Native (MAGC1_HUMAN)
ESAQSTFEGFPQSPLQIPGSPSFSS

SEQ ID NO: 248139 - protein, 13 aa, Homo sapiens
  Native (MAGC1_HUMAN)
ESASSSVMSPSFS

SEQ ID NO: 248140 - protein, 14 aa, Homo sapiens
  Native (MAGC1_HUMAN)
ESASSSVMSPSFSS

SEQ ID NO: 248141 - protein, 15 aa, Homo sapiens
  Native (MAGC1_HUMAN)
ESASSSVMSPSFSSE

SEQ ID NO: 248142 - protein, 15 aa, Homo sapiens
  Native (MAGC1_HUMAN)
ESDDTLYPLQSPQSR

SEQ ID NO: 248143 - protein, 16 aa, Homo sapiens
  Native (MAGC1_HUMAN)
ESDDTLYPLQSPQSRS

SEQ ID NO: 248144 - protein, 17 aa, Homo sapiens
  Native (MAGC1_HUMAN)
ESDDTLYPLQSPQSRSE

SEQ ID NO: 248145 - protein, 19 aa, Homo sapiens
  Native (MAGC1_HUMAN)
ESDDTLYPLQSPQSRSEGE

SEQ ID NO: 248146 - protein, 20 aa, Homo sapiens
  Native (MAGC1_HUMAN)
ESDDTLYPLQSPQSRSEGED

SEQ ID NO: 248147 - protein, 21 aa, Homo sapiens
  Native (MAGC1_HUMAN)
ESDDTLYPLQSPQSRSEGEDS

SEQ ID NO: 248148 - protein, 22 aa, Homo sapiens
  Native (MAGC1_HUMAN)
ESDDTLYPLQSPQSRSEGEDSS

SEQ ID NO: 248149 - protein, 23 aa, Homo sapiens
  Native (MAGC1_HUMAN)
ESDDTLYPLQSPQSRSEGEDSSD

SEQ ID NO: 248150 - protein, 24 aa, Homo sapiens
  Native (MAGC1_HUMAN)
ESDDTLYPLQSPQSRSEGEDSSDP

SEQ ID NO: 248151 - protein, 25 aa, Homo sapiens
  Native (MAGC1_HUMAN)
ESDDTLYPLQSPQSRSEGEDSSDPL

SEQ ID NO: 248152 - protein, 19 aa, Homo sapiens
  Native (MAGC1_HUMAN)
ESDSLTDSESLIESEPLFT

SEQ ID NO: 248153 - protein, 20 aa, Homo sapiens
  Native (MAGC1_HUMAN)
ESDSLTDSESLIESEPLFTY

SEQ ID NO: 248154 - protein, 21 aa, Homo sapiens
  Native (MAGC1_HUMAN)
ESDSLTDSESLIESEPLFTYT

SEQ ID NO: 248155 - protein, 22 aa, Homo sapiens
  Native (MAGC1_HUMAN)
ESDSLTDSESLIESEPLFTYTL

SEQ ID NO: 248156 - protein, 23 aa, Homo sapiens
  Native (MAGC1_HUMAN)
ESDSLTDSESLIESEPLFTYTLD

SEQ ID NO: 248157 - protein, 24 aa, Homo sapiens
  Native (MAGC1_HUMAN)
ESDSLTDSESLIESEPLFTYTLDE

SEQ ID NO: 248158 - protein, 25 aa, Homo sapiens
  Native (MAGC1_HUMAN)
ESDSLTDSESLIESEPLFTYTLDEK

SEQ ID NO: 248159 - protein, 14 aa, Homo sapiens
  Native (MAGC1_HUMAN)
ESEPLFTYTLDEKV

SEQ ID NO: 248160 - protein, 15 aa, Homo sapiens
  Native (MAGC1_HUMAN)
ESEPLFTYTLDEKVD

SEQ ID NO: 248161 - protein, 16 aa, Homo sapiens
  Native (MAGC1_HUMAN)
ESEPLFTYTLDEKVDE

SEQ ID NO: 248162 - protein, 17 aa, Homo sapiens
  Native (MAGC1_HUMAN)
ESEPLFTYTLDEKVDEL

SEQ ID NO: 248163 - protein, 18 aa, Homo sapiens
  Native (MAGC1_HUMAN)
ESEPLFTYTLDEKVDELA

SEQ ID NO: 248164 - protein, 19 aa, Homo sapiens
  Native (MAGC1_HUMAN)
ESEPLFTYTLDEKVDELAR

SEQ ID NO: 248165 - protein, 20 aa, Homo sapiens
  Native (MAGC1_HUMAN)
ESEPLFTYTLDEKVDELARF

SEQ ID NO: 248166 - protein, 21 aa, Homo sapiens
  Native (MAGC1_HUMAN)
ESEPLFTYTLDEKVDELARFL

SEQ ID NO: 248167 - protein, 22 aa, Homo sapiens
  Native (MAGC1_HUMAN)
ESEPLFTYTLDEKVDELARFLL

SEQ ID NO: 248168 - protein, 23 aa, Homo sapiens
  Native (MAGC1_HUMAN)
ESEPLFTYTLDEKVDELARFLLL

SEQ ID NO: 248169 - protein, 24 aa, Homo sapiens
  Native (MAGC1_HUMAN)
ESEPLFTYTLDEKVDELARFLLLK

SEQ ID NO: 248170 - protein, 25 aa, Homo sapiens
  Native (MAGC1_HUMAN)
ESEPLFTYTLDEKVDELARFLLLKY

SEQ ID NO: 248171 - protein, 13 aa, Homo sapiens
  Native (MAGC1_HUMAN)
ESLIESEPLFTYT

SEQ ID NO: 248172 - protein, 14 aa, Homo sapiens
  Native (MAGC1_HUMAN)
ESLIESEPLFTYTL

SEQ ID NO: 248173 - protein, 15 aa, Homo sapiens
  Native (MAGC1_HUMAN)
ESLIESEPLFTYTLD

SEQ ID NO: 248174 - protein, 16 aa, Homo sapiens
  Native (MAGC1_HUMAN)
ESLIESEPLFTYTLDE

SEQ ID NO: 248175 - protein, 17 aa, Homo sapiens
  Native (MAGC1_HUMAN)
ESLIESEPLFTYTLDEK

SEQ ID NO: 248176 - protein, 18 aa, Homo sapiens
  Native (MAGC1_HUMAN)
ESLIESEPLFTYTLDEKV

SEQ ID NO: 248177 - protein, 19 aa, Homo sapiens
  Native (MAGC1_HUMAN)
ESLIESEPLFTYTLDEKVD

SEQ ID NO: 248178 - protein, 20 aa, Homo sapiens
  Native (MAGC1_HUMAN)
ESLIESEPLFTYTLDEKVDE

SEQ ID NO: 248179 - protein, 21 aa, Homo sapiens
  Native (MAGC1_HUMAN)
ESLIESEPLFTYTLDEKVDEL

SEQ ID NO: 248180 - protein, 22 aa, Homo sapiens
  Native (MAGC1_HUMAN)
ESLIESEPLFTYTLDEKVDELA

SEQ ID NO: 248181 - protein, 23 aa, Homo sapiens
  Native (MAGC1_HUMAN)
ESLIESEPLFTYTLDEKVDELAR

SEQ ID NO: 248182 - protein, 24 aa, Homo sapiens
  Native (MAGC1_HUMAN)
ESLIESEPLFTYTLDEKVDELARF

SEQ ID NO: 248183 - protein, 25 aa, Homo sapiens
  Native (MAGC1_HUMAN)
ESLIESEPLFTYTLDEKVDELARFL

SEQ ID NO: 248184 - protein, 14 aa, Homo sapiens
  Native (MAGC1_HUMAN)
ESPLQSPVISFSSS

SEQ ID NO: 248185 - protein, 15 aa, Homo sapiens
  Native (MAGC1_HUMAN)
ESPLQSPVISFSSST

SEQ ID NO: 248186 - protein, 16 aa, Homo sapiens
  Native (MAGC1_HUMAN)
ESPLQSPVISFSSSTS

SEQ ID NO: 248187 - protein, 17 aa, Homo sapiens
  Native (MAGC1_HUMAN)
ESPLQSPVISFSSSTSL

SEQ ID NO: 248188 - protein, 18 aa, Homo sapiens
  Native (MAGC1_HUMAN)
ESPLQSPVISFSSSTSLS

SEQ ID NO: 248189 - protein, 19 aa, Homo sapiens
  Native (MAGC1_HUMAN)
ESPLQSPVISFSSSTSLSP

SEQ ID NO: 248190 - protein, 20 aa, Homo sapiens
  Native (MAGC1_HUMAN)
ESPLQSPVISFSSSTSLSPF

SEQ ID NO: 248191 - protein, 21 aa, Homo sapiens
  Native (MAGC1_HUMAN)
ESPLQSPVISFSSSTSLSPFS

SEQ ID NO: 248192 - protein, 22 aa, Homo sapiens
  Native (MAGC1_HUMAN)
ESPLQSPVISFSSSTSLSPFSE

SEQ ID NO: 248193 - protein, 23 aa, Homo sapiens
  Native (MAGC1_HUMAN)
ESPLQSPVISFSSSTSLSPFSEE

SEQ ID NO: 248194 - protein, 24 aa, Homo sapiens
  Native (MAGC1_HUMAN)
ESPLQSPVISFSSSTSLSPFSEES

SEQ ID NO: 248195 - protein, 25 aa, Homo sapiens
  Native (MAGC1_HUMAN)
ESPLQSPVISFSSSTSLSPFSEESS

SEQ ID NO: 248196 - protein, 19 aa, Homo sapiens
  Native (MAGC1_HUMAN)
ESSSPVDEYTSSSDTLLES

SEQ ID NO: 248197 - protein, 20 aa, Homo sapiens
  Native (MAGC1_HUMAN)
ESSSPVDEYTSSSDTLLESD

SEQ ID NO: 248198 - protein, 22 aa, Homo sapiens
  Native (MAGC1_HUMAN)
ESSSPVDEYTSSSDTLLESDSL

SEQ ID NO: 248199 - protein, 23 aa, Homo sapiens
  Native (MAGC1_HUMAN)
ESSSPVDEYTSSSDTLLESDSLT

SEQ ID NO: 248200 - protein, 24 aa, Homo sapiens
  Native (MAGC1_HUMAN)
ESSSPVDEYTSSSDTLLESDSLTD

SEQ ID NO: 248201 - protein, 25 aa, Homo sapiens
  Native (MAGC1_HUMAN)
ESSSPVDEYTSSSDTLLESDSLTDS

SEQ ID NO: 248202 - protein, 17 aa, Homo sapiens
  Native (MAGC1_HUMAN)
ESTQSPFEGFPQSPLQI

SEQ ID NO: 248203 - protein, 19 aa, Homo sapiens
  Native (MAGC1_HUMAN)
ESTQSPFEGFPQSPLQIPV

SEQ ID NO: 248204 - protein, 20 aa, Homo sapiens
  Native (MAGC1_HUMAN)
ESTQSPFEGFPQSPLQIPVS

SEQ ID NO: 248205 - protein, 21 aa, Homo sapiens
  Native (MAGC1_HUMAN)
ESTQSPFEGFPQSPLQIPVSR

SEQ ID NO: 248206 - protein, 22 aa, Homo sapiens
  Native (MAGC1_HUMAN)
ESTQSPFEGFPQSPLQIPVSRS

SEQ ID NO: 248207 - protein, 23 aa, Homo sapiens
  Native (MAGC1_HUMAN)
ESTQSPFEGFPQSPLQIPVSRSF

SEQ ID NO: 248208 - protein, 24 aa, Homo sapiens
  Native (MAGC1_HUMAN)
ESTQSPFEGFPQSPLQIPVSRSFS

SEQ ID NO: 248209 - protein, 25 aa, Homo sapiens
  Native (MAGC1_HUMAN)
ESTQSPFEGFPQSPLQIPVSRSFSS

SEQ ID NO: 248210 - protein, 15 aa, Homo sapiens
  Native (MAGC1_HUMAN)
ESTQSPFEGFPQSVL

SEQ ID NO: 248211 - protein, 16 aa, Homo sapiens
  Native (MAGC1_HUMAN)
ESTQSPFEGFPQSVLQ

SEQ ID NO: 248212 - protein, 17 aa, Homo sapiens
  Native (MAGC1_HUMAN)
ESTQSPFEGFPQSVLQI

SEQ ID NO: 248213 - protein, 19 aa, Homo sapiens
  Native (MAGC1_HUMAN)
ESTQSPFEGFPQSVLQIPV

SEQ ID NO: 248214 - protein, 20 aa, Homo sapiens
  Native (MAGC1_HUMAN)
ESTQSPFEGFPQSVLQIPVS

SEQ ID NO: 248215 - protein, 21 aa, Homo sapiens
  Native (MAGC1_HUMAN)
ESTQSPFEGFPQSVLQIPVSA

SEQ ID NO: 248216 - protein, 22 aa, Homo sapiens
  Native (MAGC1_HUMAN)
ESTQSPFEGFPQSVLQIPVSAA

SEQ ID NO: 248217 - protein, 23 aa, Homo sapiens
  Native (MAGC1_HUMAN)
ESTQSPFEGFPQSVLQIPVSAAS

SEQ ID NO: 248218 - protein, 24 aa, Homo sapiens
  Native (MAGC1_HUMAN)
ESTQSPFEGFPQSVLQIPVSAASS

SEQ ID NO: 248219 - protein, 25 aa, Homo sapiens
  Native (MAGC1_HUMAN)
ESTQSPFEGFPQSVLQIPVSAASSS

SEQ ID NO: 248220 - protein, 16 aa, Homo sapiens
  Native (MAGC1_HUMAN)
EVDPDDSYVFVNTLDL

SEQ ID NO: 248221 - protein, 17 aa, Homo sapiens
  Native (MAGC1_HUMAN)
EVDPDDSYVFVNTLDLT

SEQ ID NO: 248222 - protein, 18 aa, Homo sapiens
  Native (MAGC1_HUMAN)
EVDPDDSYVFVNTLDLTS

SEQ ID NO: 248223 - protein, 19 aa, Homo sapiens
  Native (MAGC1_HUMAN)
EVDPDDSYVFVNTLDLTSE

SEQ ID NO: 248224 - protein, 20 aa, Homo sapiens
  Native (MAGC1_HUMAN)
EVDPDDSYVFVNTLDLTSEG

SEQ ID NO: 248225 - protein, 21 aa, Homo sapiens
  Native (MAGC1_HUMAN)
EVDPDDSYVFVNTLDLTSEGC

SEQ ID NO: 248226 - protein, 22 aa, Homo sapiens
  Native (MAGC1_HUMAN)
EVDPDDSYVFVNTLDLTSEGCL

SEQ ID NO: 248227 - protein, 23 aa, Homo sapiens
  Native (MAGC1_HUMAN)
EVDPDDSYVFVNTLDLTSEGCLS

SEQ ID NO: 248228 - protein, 24 aa, Homo sapiens
  Native (MAGC1_HUMAN)
EVDPDDSYVFVNTLDLTSEGCLSD

SEQ ID NO: 248229 - protein, 25 aa, Homo sapiens
  Native (MAGC1_HUMAN)
EVDPDDSYVFVNTLDLTSEGCLSDE

SEQ ID NO: 248230 - protein, 13 aa, Homo sapiens
  Native (MAGC1_HUMAN)
EVIKRKVVEFLAM

SEQ ID NO: 248231 - protein, 14 aa, Homo sapiens
  Native (MAGC1_HUMAN)
EVIKRKVVEFLAML

SEQ ID NO: 248232 - protein, 15 aa, Homo sapiens
  Native (MAGC1_HUMAN)
EVIKRKVVEFLAMLK

SEQ ID NO: 248233 - protein, 16 aa, Homo sapiens
  Native (MAGC1_HUMAN)
EVIKRKVVEFLAMLKN

SEQ ID NO: 248234 - protein, 17 aa, Homo sapiens
  Native (MAGC1_HUMAN)
EVIKRKVVEFLAMLKNT

SEQ ID NO: 248235 - protein, 18 aa, Homo sapiens
  Native (MAGC1_HUMAN)
EVIKRKVVEFLAMLKNTV

SEQ ID NO: 248236 - protein, 19 aa, Homo sapiens
  Native (MAGC1_HUMAN)
EVIKRKVVEFLAMLKNTVP

SEQ ID NO: 248237 - protein, 20 aa, Homo sapiens
  Native (MAGC1_HUMAN)
EVIKRKVVEFLAMLKNTVPI

SEQ ID NO: 248238 - protein, 21 aa, Homo sapiens
  Native (MAGC1_HUMAN)
EVIKRKVVEFLAMLKNTVPIT

SEQ ID NO: 248239 - protein, 22 aa, Homo sapiens
  Native (MAGC1_HUMAN)
EVIKRKVVEFLAMLKNTVPITF

SEQ ID NO: 248240 - protein, 23 aa, Homo sapiens
  Native (MAGC1_HUMAN)
EVIKRKVVEFLAMLKNTVPITFP

SEQ ID NO: 248241 - protein, 24 aa, Homo sapiens
  Native (MAGC1_HUMAN)
EVIKRKVVEFLAMLKNTVPITFPS

SEQ ID NO: 248242 - protein, 25 aa, Homo sapiens
  Native (MAGC1_HUMAN)
EVIKRKVVEFLAMLKNTVPITFPSS

SEQ ID NO: 248243 - protein, 13 aa, Homo sapiens
  Native (MAGC1_HUMAN)
EVIWDVLSGIGVR

SEQ ID NO: 248244 - protein, 14 aa, Homo sapiens
  Native (MAGC1_HUMAN)
EVIWDVLSGIGVRA

SEQ ID NO: 248245 - protein, 15 aa, Homo sapiens
  Native (MAGC1_HUMAN)
EVIWDVLSGIGVRAG

SEQ ID NO: 248246 - protein, 16 aa, Homo sapiens
  Native (MAGC1_HUMAN)
EVIWDVLSGIGVRAGR

SEQ ID NO: 248247 - protein, 17 aa, Homo sapiens
  Native (MAGC1_HUMAN)
EVIWDVLSGIGVRAGRE

SEQ ID NO: 248248 - protein, 18 aa, Homo sapiens
  Native (MAGC1_HUMAN)
EVIWDVLSGIGVRAGREH

SEQ ID NO: 248249 - protein, 19 aa, Homo sapiens
  Native (MAGC1_HUMAN)
EVIWDVLSGIGVRAGREHF

SEQ ID NO: 248250 - protein, 20 aa, Homo sapiens
  Native (MAGC1_HUMAN)
EVIWDVLSGIGVRAGREHFA

SEQ ID NO: 248251 - protein, 21 aa, Homo sapiens
  Native (MAGC1_HUMAN)
EVIWDVLSGIGVRAGREHFAF

SEQ ID NO: 248252 - protein, 22 aa, Homo sapiens
  Native (MAGC1_HUMAN)
EVIWDVLSGIGVRAGREHFAFG

SEQ ID NO: 248253 - protein, 23 aa, Homo sapiens
  Native (MAGC1_HUMAN)
EVIWDVLSGIGVRAGREHFAFGE

SEQ ID NO: 248254 - protein, 24 aa, Homo sapiens
  Native (MAGC1_HUMAN)
EVIWDVLSGIGVRAGREHFAFGEP

SEQ ID NO: 248255 - protein, 25 aa, Homo sapiens
  Native (MAGC1_HUMAN)
EVIWDVLSGIGVRAGREHFAFGEPR

SEQ ID NO: 248256 - protein, 19 aa, Homo sapiens
  Native (MAGC1_HUMAN)
EVPNSSPPRYEFLWGPRAH

SEQ ID NO: 248257 - protein, 20 aa, Homo sapiens
  Native (MAGC1_HUMAN)
EVPNSSPPRYEFLWGPRAHS

SEQ ID NO: 248258 - protein, 21 aa, Homo sapiens
  Native (MAGC1_HUMAN)
EVPNSSPPRYEFLWGPRAHSE

SEQ ID NO: 248259 - protein, 22 aa, Homo sapiens
  Native (MAGC1_HUMAN)
EVPNSSPPRYEFLWGPRAHSEV

SEQ ID NO: 248260 - protein, 23 aa, Homo sapiens
  Native (MAGC1_HUMAN)
EVPNSSPPRYEFLWGPRAHSEVI

SEQ ID NO: 248261 - protein, 24 aa, Homo sapiens
  Native (MAGC1_HUMAN)
EVPNSSPPRYEFLWGPRAHSEVIK

SEQ ID NO: 248262 - protein, 25 aa, Homo sapiens
  Native (MAGC1_HUMAN)
EVPNSSPPRYEFLWGPRAHSEVIKR

SEQ ID NO: 248263 - protein, 15 aa, Homo sapiens
  Native (MAGC1_HUMAN)
EWEDSLSPLHFPQFP

SEQ ID NO: 248264 - protein, 16 aa, Homo sapiens
  Native (MAGC1_HUMAN)
EWEDSLSPLHFPQFPP

SEQ ID NO: 248265 - protein, 17 aa, Homo sapiens
  Native (MAGC1_HUMAN)
EWEDSLSPLHFPQFPPQ

SEQ ID NO: 248266 - protein, 19 aa, Homo sapiens
  Native (MAGC1_HUMAN)
EWEDSLSPLHFPQFPPQGE

SEQ ID NO: 248267 - protein, 20 aa, Homo sapiens
  Native (MAGC1_HUMAN)
EWEDSLSPLHFPQFPPQGED

SEQ ID NO: 248268 - protein, 21 aa, Homo sapiens
  Native (MAGC1_HUMAN)
EWEDSLSPLHFPQFPPQGEDF

SEQ ID NO: 248269 - protein, 22 aa, Homo sapiens
  Native (MAGC1_HUMAN)
EWEDSLSPLHFPQFPPQGEDFQ

SEQ ID NO: 248270 - protein, 23 aa, Homo sapiens
  Native (MAGC1_HUMAN)
EWEDSLSPLHFPQFPPQGEDFQS

SEQ ID NO: 248271 - protein, 24 aa, Homo sapiens
  Native (MAGC1_HUMAN)
EWEDSLSPLHFPQFPPQGEDFQSS

SEQ ID NO: 248272 - protein, 25 aa, Homo sapiens
  Native (MAGC1_HUMAN)
EWEDSLSPLHFPQFPPQGEDFQSSL

SEQ ID NO: 248273 - protein, 21 aa, Homo sapiens
  Native (MAGC1_HUMAN)
EYREVPNSSPPRYEFLWGPRA

SEQ ID NO: 248274 - protein, 22 aa, Homo sapiens
  Native (MAGC1_HUMAN)
EYREVPNSSPPRYEFLWGPRAH

SEQ ID NO: 248275 - protein, 23 aa, Homo sapiens
  Native (MAGC1_HUMAN)
EYREVPNSSPPRYEFLWGPRAHS

SEQ ID NO: 248276 - protein, 24 aa, Homo sapiens
  Native (MAGC1_HUMAN)
EYREVPNSSPPRYEFLWGPRAHSE

SEQ ID NO: 248277 - protein, 25 aa, Homo sapiens
  Native (MAGC1_HUMAN)
EYREVPNSSPPRYEFLWGPRAHSEV

SEQ ID NO: 248278 - protein, 15 aa, Homo sapiens
  Native (MAGC1_HUMAN)
EYTSSSDTLLESDSL

SEQ ID NO: 248279 - protein, 16 aa, Homo sapiens
  Native (MAGC1_HUMAN)
EYTSSSDTLLESDSLT

SEQ ID NO: 248280 - protein, 19 aa, Homo sapiens
  Native (MAGC1_HUMAN)
EYTSSSDTLLESDSLTDSE

SEQ ID NO: 248281 - protein, 20 aa, Homo sapiens
  Native (MAGC1_HUMAN)
EYTSSSDTLLESDSLTDSES

SEQ ID NO: 248282 - protein, 24 aa, Homo sapiens
  Native (MAGC1_HUMAN)
EYTSSSDTLLESDSLTDSESLIES

SEQ ID NO: 248283 - protein, 25 aa, Homo sapiens
  Native (MAGC1_HUMAN)
EYTSSSDTLLESDSLTDSESLIESE

SEQ ID NO: 248284 - protein, 15 aa, Homo sapiens
  Native (MAGC1_HUMAN)
FAFGEPRELLTKVWV

SEQ ID NO: 248285 - protein, 17 aa, Homo sapiens
  Native (MAGC1_HUMAN)
FAFGEPRELLTKVWVQE

SEQ ID NO: 248286 - protein, 18 aa, Homo sapiens
  Native (MAGC1_HUMAN)
FAFGEPRELLTKVWVQEH

SEQ ID NO: 248287 - protein, 19 aa, Homo sapiens
  Native (MAGC1_HUMAN)
FAFGEPRELLTKVWVQEHY

SEQ ID NO: 248288 - protein, 20 aa, Homo sapiens
  Native (MAGC1_HUMAN)
FAFGEPRELLTKVWVQEHYL

SEQ ID NO: 248289 - protein, 21 aa, Homo sapiens
  Native (MAGC1_HUMAN)
FAFGEPRELLTKVWVQEHYLE

SEQ ID NO: 248290 - protein, 22 aa, Homo sapiens
  Native (MAGC1_HUMAN)
FAFGEPRELLTKVWVQEHYLEY

SEQ ID NO: 248291 - protein, 23 aa, Homo sapiens
  Native (MAGC1_HUMAN)
FAFGEPRELLTKVWVQEHYLEYR

SEQ ID NO: 248292 - protein, 24 aa, Homo sapiens
  Native (MAGC1_HUMAN)
FAFGEPRELLTKVWVQEHYLEYRE

SEQ ID NO: 248293 - protein, 25 aa, Homo sapiens
  Native (MAGC1_HUMAN)
FAFGEPRELLTKVWVQEHYLEYREV

SEQ ID NO: 248294 - protein, 19 aa, Homo sapiens
  Native (MAGC1_HUMAN)
FAQSPLQIPVSPSSSSTLL

SEQ ID NO: 248295 - protein, 20 aa, Homo sapiens
  Native (MAGC1_HUMAN)
FAQSPLQIPVSPSSSSTLLS

SEQ ID NO: 248296 - protein, 21 aa, Homo sapiens
  Native (MAGC1_HUMAN)
FAQSPLQIPVSPSSSSTLLSL

SEQ ID NO: 248297 - protein, 22 aa, Homo sapiens
  Native (MAGC1_HUMAN)
FAQSPLQIPVSPSSSSTLLSLF

SEQ ID NO: 248298 - protein, 23 aa, Homo sapiens
  Native (MAGC1_HUMAN)
FAQSPLQIPVSPSSSSTLLSLFQ

SEQ ID NO: 248299 - protein, 24 aa, Homo sapiens
  Native (MAGC1_HUMAN)
FAQSPLQIPVSPSSSSTLLSLFQS

SEQ ID NO: 248300 - protein, 25 aa, Homo sapiens
  Native (MAGC1_HUMAN)
FAQSPLQIPVSPSSSSTLLSLFQSF

SEQ ID NO: 248301 - protein, 15 aa, Homo sapiens
  Native (MAGC1_HUMAN)
FAQSSLQIPVSPSFS

SEQ ID NO: 248302 - protein, 16 aa, Homo sapiens
  Native (MAGC1_HUMAN)
FAQSSLQIPVSPSFSS

SEQ ID NO: 248303 - protein, 17 aa, Homo sapiens
  Native (MAGC1_HUMAN)
FAQSSLQIPVSPSFSST

SEQ ID NO: 248304 - protein, 19 aa, Homo sapiens
  Native (MAGC1_HUMAN)
FAQSSLQIPVSPSFSSTLV

SEQ ID NO: 248305 - protein, 20 aa, Homo sapiens
  Native (MAGC1_HUMAN)
FAQSSLQIPVSPSFSSTLVS

SEQ ID NO: 248306 - protein, 21 aa, Homo sapiens
  Native (MAGC1_HUMAN)
FAQSSLQIPVSPSFSSTLVSL

SEQ ID NO: 248307 - protein, 22 aa, Homo sapiens
  Native (MAGC1_HUMAN)
FAQSSLQIPVSPSFSSTLVSLF

SEQ ID NO: 248308 - protein, 23 aa, Homo sapiens
  Native (MAGC1_HUMAN)
FAQSSLQIPVSPSFSSTLVSLFQ

SEQ ID NO: 248309 - protein, 24 aa, Homo sapiens
  Native (MAGC1_HUMAN)
FAQSSLQIPVSPSFSSTLVSLFQS

SEQ ID NO: 248310 - protein, 25 aa, Homo sapiens
  Native (MAGC1_HUMAN)
FAQSSLQIPVSPSFSSTLVSLFQSS

SEQ ID NO: 248311 - protein, 13 aa, Homo sapiens
  Native (MAGC1_HUMAN)
FEGFAQSPLQIPV

SEQ ID NO: 248312 - protein, 14 aa, Homo sapiens
  Native (MAGC1_HUMAN)
FEGFAQSPLQIPVS

SEQ ID NO: 248313 - protein, 15 aa, Homo sapiens
  Native (MAGC1_HUMAN)
FEGFAQSPLQIPVSP

SEQ ID NO: 248314 - protein, 16 aa, Homo sapiens
  Native (MAGC1_HUMAN)
FEGFAQSPLQIPVSPS

SEQ ID NO: 248315 - protein, 17 aa, Homo sapiens
  Native (MAGC1_HUMAN)
FEGFAQSPLQIPVSPSS

SEQ ID NO: 248316 - protein, 18 aa, Homo sapiens
  Native (MAGC1_HUMAN)
FEGFAQSPLQIPVSPSSS

SEQ ID NO: 248317 - protein, 19 aa, Homo sapiens
  Native (MAGC1_HUMAN)
FEGFAQSPLQIPVSPSSSS

SEQ ID NO: 248318 - protein, 20 aa, Homo sapiens
  Native (MAGC1_HUMAN)
FEGFAQSPLQIPVSPSSSST

SEQ ID NO: 248319 - protein, 21 aa, Homo sapiens
  Native (MAGC1_HUMAN)
FEGFAQSPLQIPVSPSSSSTL

SEQ ID NO: 248320 - protein, 22 aa, Homo sapiens
  Native (MAGC1_HUMAN)
FEGFAQSPLQIPVSPSSSSTLL

SEQ ID NO: 248321 - protein, 23 aa, Homo sapiens
  Native (MAGC1_HUMAN)
FEGFAQSPLQIPVSPSSSSTLLS

SEQ ID NO: 248322 - protein, 24 aa, Homo sapiens
  Native (MAGC1_HUMAN)
FEGFAQSPLQIPVSPSSSSTLLSL

SEQ ID NO: 248323 - protein, 25 aa, Homo sapiens
  Native (MAGC1_HUMAN)
FEGFAQSPLQIPVSPSSSSTLLSLF

SEQ ID NO: 248324 - protein, 13 aa, Homo sapiens
  Native (MAGC1_HUMAN)
FEGFAQSSLQIPV

SEQ ID NO: 248325 - protein, 14 aa, Homo sapiens
  Native (MAGC1_HUMAN)
FEGFAQSSLQIPVS

SEQ ID NO: 248326 - protein, 15 aa, Homo sapiens
  Native (MAGC1_HUMAN)
FEGFAQSSLQIPVSP

SEQ ID NO: 248327 - protein, 16 aa, Homo sapiens
  Native (MAGC1_HUMAN)
FEGFAQSSLQIPVSPS

SEQ ID NO: 248328 - protein, 17 aa, Homo sapiens
  Native (MAGC1_HUMAN)
FEGFAQSSLQIPVSPSF

SEQ ID NO: 248329 - protein, 18 aa, Homo sapiens
  Native (MAGC1_HUMAN)
FEGFAQSSLQIPVSPSFS

SEQ ID NO: 248330 - protein, 19 aa, Homo sapiens
  Native (MAGC1_HUMAN)
FEGFAQSSLQIPVSPSFSS

SEQ ID NO: 248331 - protein, 20 aa, Homo sapiens
  Native (MAGC1_HUMAN)
FEGFAQSSLQIPVSPSFSST

SEQ ID NO: 248332 - protein, 21 aa, Homo sapiens
  Native (MAGC1_HUMAN)
FEGFAQSSLQIPVSPSFSSTL

SEQ ID NO: 248333 - protein, 22 aa, Homo sapiens
  Native (MAGC1_HUMAN)
FEGFAQSSLQIPVSPSFSSTLV

SEQ ID NO: 248334 - protein, 23 aa, Homo sapiens
  Native (MAGC1_HUMAN)
FEGFAQSSLQIPVSPSFSSTLVS

SEQ ID NO: 248335 - protein, 24 aa, Homo sapiens
  Native (MAGC1_HUMAN)
FEGFAQSSLQIPVSPSFSSTLVSL

SEQ ID NO: 248336 - protein, 25 aa, Homo sapiens
  Native (MAGC1_HUMAN)
FEGFAQSSLQIPVSPSFSSTLVSLF

SEQ ID NO: 248337 - protein, 14 aa, Homo sapiens
  Native (MAGC1_HUMAN)
FEGFPQSLLQIPMT

SEQ ID NO: 248338 - protein, 15 aa, Homo sapiens
  Native (MAGC1_HUMAN)
FEGFPQSLLQIPMTS

SEQ ID NO: 248339 - protein, 16 aa, Homo sapiens
  Native (MAGC1_HUMAN)
FEGFPQSLLQIPMTSS

SEQ ID NO: 248340 - protein, 17 aa, Homo sapiens
  Native (MAGC1_HUMAN)
FEGFPQSLLQIPMTSSF

SEQ ID NO: 248341 - protein, 18 aa, Homo sapiens
  Native (MAGC1_HUMAN)
FEGFPQSLLQIPMTSSFS

SEQ ID NO: 248342 - protein, 19 aa, Homo sapiens
  Native (MAGC1_HUMAN)
FEGFPQSLLQIPMTSSFSS

SEQ ID NO: 248343 - protein, 20 aa, Homo sapiens
  Native (MAGC1_HUMAN)
FEGFPQSLLQIPMTSSFSST

SEQ ID NO: 248344 - protein, 21 aa, Homo sapiens
  Native (MAGC1_HUMAN)
FEGFPQSLLQIPMTSSFSSTL

SEQ ID NO: 248345 - protein, 22 aa, Homo sapiens
  Native (MAGC1_HUMAN)
FEGFPQSLLQIPMTSSFSSTLL

SEQ ID NO: 248346 - protein, 23 aa, Homo sapiens
  Native (MAGC1_HUMAN)
FEGFPQSLLQIPMTSSFSSTLLS

SEQ ID NO: 248347 - protein, 24 aa, Homo sapiens
  Native (MAGC1_HUMAN)
FEGFPQSLLQIPMTSSFSSTLLSI

SEQ ID NO: 248348 - protein, 25 aa, Homo sapiens
  Native (MAGC1_HUMAN)
FEGFPQSLLQIPMTSSFSSTLLSIF

SEQ ID NO: 248349 - protein, 20 aa, Homo sapiens
  Native (MAGC1_HUMAN)
FEGFPQSPLQIPGSPSFSST

SEQ ID NO: 248350 - protein, 22 aa, Homo sapiens
  Native (MAGC1_HUMAN)
FEGFPQSPLQIPGSPSFSSTLL

SEQ ID NO: 248351 - protein, 23 aa, Homo sapiens
  Native (MAGC1_HUMAN)
FEGFPQSPLQIPGSPSFSSTLLS

SEQ ID NO: 248352 - protein, 24 aa, Homo sapiens
  Native (MAGC1_HUMAN)
FEGFPQSPLQIPGSPSFSSTLLSL

SEQ ID NO: 248353 - protein, 25 aa, Homo sapiens
  Native (MAGC1_HUMAN)
FEGFPQSPLQIPGSPSFSSTLLSLF

SEQ ID NO: 248354 - protein, 19 aa, Homo sapiens
  Native (MAGC1_HUMAN)
FEGFPQSPLQIPMTSSFSS

SEQ ID NO: 248355 - protein, 20 aa, Homo sapiens
  Native (MAGC1_HUMAN)
FEGFPQSPLQIPMTSSFSST

SEQ ID NO: 248356 - protein, 21 aa, Homo sapiens
  Native (MAGC1_HUMAN)
FEGFPQSPLQIPMTSSFSSTL

SEQ ID NO: 248357 - protein, 22 aa, Homo sapiens
  Native (MAGC1_HUMAN)
FEGFPQSPLQIPMTSSFSSTLL

SEQ ID NO: 248358 - protein, 23 aa, Homo sapiens
  Native (MAGC1_HUMAN)
FEGFPQSPLQIPMTSSFSSTLLS

SEQ ID NO: 248359 - protein, 24 aa, Homo sapiens
  Native (MAGC1_HUMAN)
FEGFPQSPLQIPMTSSFSSTLLSI

SEQ ID NO: 248360 - protein, 25 aa, Homo sapiens
  Native (MAGC1_HUMAN)
FEGFPQSPLQIPMTSSFSSTLLSIL

SEQ ID NO: 248361 - protein, 20 aa, Homo sapiens
  Native (MAGC1_HUMAN)
FEGFPQSPLQIPVSRSFSST

SEQ ID NO: 248362 - protein, 21 aa, Homo sapiens
  Native (MAGC1_HUMAN)
FEGFPQSPLQIPVSRSFSSTL

SEQ ID NO: 248363 - protein, 22 aa, Homo sapiens
  Native (MAGC1_HUMAN)
FEGFPQSPLQIPVSRSFSSTLL

SEQ ID NO: 248364 - protein, 23 aa, Homo sapiens
  Native (MAGC1_HUMAN)
FEGFPQSPLQIPVSRSFSSTLLS

SEQ ID NO: 248365 - protein, 24 aa, Homo sapiens
  Native (MAGC1_HUMAN)
FEGFPQSPLQIPVSRSFSSTLLSI

SEQ ID NO: 248366 - protein, 25 aa, Homo sapiens
  Native (MAGC1_HUMAN)
FEGFPQSPLQIPVSRSFSSTLLSIF

SEQ ID NO: 248367 - protein, 20 aa, Homo sapiens
  Native (MAGC1_HUMAN)
FEGFPQSPLQIPVSSSFSYT

SEQ ID NO: 248368 - protein, 21 aa, Homo sapiens
  Native (MAGC1_HUMAN)
FEGFPQSPLQIPVSSSFSYTL

SEQ ID NO: 248369 - protein, 22 aa, Homo sapiens
  Native (MAGC1_HUMAN)
FEGFPQSPLQIPVSSSFSYTLL

SEQ ID NO: 248370 - protein, 23 aa, Homo sapiens
  Native (MAGC1_HUMAN)
FEGFPQSPLQIPVSSSFSYTLLS

SEQ ID NO: 248371 - protein, 24 aa, Homo sapiens
  Native (MAGC1_HUMAN)
FEGFPQSPLQIPVSSSFSYTLLSL

SEQ ID NO: 248372 - protein, 25 aa, Homo sapiens
  Native (MAGC1_HUMAN)
FEGFPQSPLQIPVSSSFSYTLLSLF

SEQ ID NO: 248373 - protein, 20 aa, Homo sapiens
  Native (MAGC1_HUMAN)
FEGFPQSPLQIPVSSSSSSS

SEQ ID NO: 248374 - protein, 21 aa, Homo sapiens
  Native (MAGC1_HUMAN)
FEGFPQSPLQIPVSSSSSSST

SEQ ID NO: 248375 - protein, 22 aa, Homo sapiens
  Native (MAGC1_HUMAN)
FEGFPQSPLQIPVSSSSSSSTL

SEQ ID NO: 248376 - protein, 23 aa, Homo sapiens
  Native (MAGC1_HUMAN)
FEGFPQSPLQIPVSSSSSSSTLL

SEQ ID NO: 248377 - protein, 24 aa, Homo sapiens
  Native (MAGC1_HUMAN)
FEGFPQSPLQIPVSSSSSSSTLLS

SEQ ID NO: 248378 - protein, 25 aa, Homo sapiens
  Native (MAGC1_HUMAN)
FEGFPQSPLQIPVSSSSSSSTLLSL

SEQ ID NO: 248379 - protein, 20 aa, Homo sapiens
  Native (MAGC1_HUMAN)
FEGFPQSPLQIPVSSSSSST

SEQ ID NO: 248380 - protein, 21 aa, Homo sapiens
  Native (MAGC1_HUMAN)
FEGFPQSPLQIPVSSSSSSTL

SEQ ID NO: 248381 - protein, 22 aa, Homo sapiens
  Native (MAGC1_HUMAN)
FEGFPQSPLQIPVSSSSSSTLL

SEQ ID NO: 248382 - protein, 23 aa, Homo sapiens
  Native (MAGC1_HUMAN)
FEGFPQSPLQIPVSSSSSSTLLS

SEQ ID NO: 248383 - protein, 24 aa, Homo sapiens
  Native (MAGC1_HUMAN)
FEGFPQSPLQIPVSSSSSSTLLSL

SEQ ID NO: 248384 - protein, 25 aa, Homo sapiens
  Native (MAGC1_HUMAN)
FEGFPQSPLQIPVSSSSSSTLLSLF

SEQ ID NO: 248385 - protein, 14 aa, Homo sapiens
  Native (MAGC1_HUMAN)
FEGFPQSVLQIPVS

SEQ ID NO: 248386 - protein, 15 aa, Homo sapiens
  Native (MAGC1_HUMAN)
FEGFPQSVLQIPVSA

SEQ ID NO: 248387 - protein, 16 aa, Homo sapiens
  Native (MAGC1_HUMAN)
FEGFPQSVLQIPVSAA

SEQ ID NO: 248388 - protein, 17 aa, Homo sapiens
  Native (MAGC1_HUMAN)
FEGFPQSVLQIPVSAAS

SEQ ID NO: 248389 - protein, 18 aa, Homo sapiens
  Native (MAGC1_HUMAN)
FEGFPQSVLQIPVSAASS

SEQ ID NO: 248390 - protein, 19 aa, Homo sapiens
  Native (MAGC1_HUMAN)
FEGFPQSVLQIPVSAASSS

SEQ ID NO: 248391 - protein, 20 aa, Homo sapiens
  Native (MAGC1_HUMAN)
FEGFPQSVLQIPVSAASSST

SEQ ID NO: 248392 - protein, 21 aa, Homo sapiens
  Native (MAGC1_HUMAN)
FEGFPQSVLQIPVSAASSSTL

SEQ ID NO: 248393 - protein, 22 aa, Homo sapiens
  Native (MAGC1_HUMAN)
FEGFPQSVLQIPVSAASSSTLV

SEQ ID NO: 248394 - protein, 23 aa, Homo sapiens
  Native (MAGC1_HUMAN)
FEGFPQSVLQIPVSAASSSTLVS

SEQ ID NO: 248395 - protein, 24 aa, Homo sapiens
  Native (MAGC1_HUMAN)
FEGFPQSVLQIPVSAASSSTLVSI

SEQ ID NO: 248396 - protein, 25 aa, Homo sapiens
  Native (MAGC1_HUMAN)
FEGFPQSVLQIPVSAASSSTLVSIF

SEQ ID NO: 248397 - protein, 13 aa, Homo sapiens
  Native (MAGC1_HUMAN)
FFSSALLSIFQSS

SEQ ID NO: 248398 - protein, 14 aa, Homo sapiens
  Native (MAGC1_HUMAN)
FFSSALLSIFQSSP

SEQ ID NO: 248399 - protein, 15 aa, Homo sapiens
  Native (MAGC1_HUMAN)
FFSSALLSIFQSSPE

SEQ ID NO: 248400 - protein, 16 aa, Homo sapiens
  Native (MAGC1_HUMAN)
FFSSALLSIFQSSPES

SEQ ID NO: 248401 - protein, 17 aa, Homo sapiens
  Native (MAGC1_HUMAN)
FFSSALLSIFQSSPEST

SEQ ID NO: 248402 - protein, 18 aa, Homo sapiens
  Native (MAGC1_HUMAN)
FFSSALLSIFQSSPESTQ

SEQ ID NO: 248403 - protein, 19 aa, Homo sapiens
  Native (MAGC1_HUMAN)
FFSSALLSIFQSSPESTQS

SEQ ID NO: 248404 - protein, 20 aa, Homo sapiens
  Native (MAGC1_HUMAN)
FFSSALLSIFQSSPESTQSP

SEQ ID NO: 248405 - protein, 21 aa, Homo sapiens
  Native (MAGC1_HUMAN)
FFSSALLSIFQSSPESTQSPF

SEQ ID NO: 248406 - protein, 22 aa, Homo sapiens
  Native (MAGC1_HUMAN)
FFSSALLSIFQSSPESTQSPFE

SEQ ID NO: 248407 - protein, 23 aa, Homo sapiens
  Native (MAGC1_HUMAN)
FFSSALLSIFQSSPESTQSPFEG

SEQ ID NO: 248408 - protein, 24 aa, Homo sapiens
  Native (MAGC1_HUMAN)
FFSSALLSIFQSSPESTQSPFEGF

SEQ ID NO: 248409 - protein, 25 aa, Homo sapiens
  Native (MAGC1_HUMAN)
FFSSALLSIFQSSPESTQSPFEGFP

SEQ ID NO: 248410 - protein, 13 aa, Homo sapiens
  Native (MAGC1_HUMAN)
FFSYTLASLLQSS

SEQ ID NO: 248411 - protein, 14 aa, Homo sapiens
  Native (MAGC1_HUMAN)
FFSYTLASLLQSSH

SEQ ID NO: 248412 - protein, 15 aa, Homo sapiens
  Native (MAGC1_HUMAN)
FFSYTLASLLQSSHE

SEQ ID NO: 248413 - protein, 16 aa, Homo sapiens
  Native (MAGC1_HUMAN)
FFSYTLASLLQSSHES

SEQ ID NO: 248414 - protein, 17 aa, Homo sapiens
  Native (MAGC1_HUMAN)
FFSYTLASLLQSSHESP

SEQ ID NO: 248415 - protein, 18 aa, Homo sapiens
  Native (MAGC1_HUMAN)
FFSYTLASLLQSSHESPQ

SEQ ID NO: 248416 - protein, 19 aa, Homo sapiens
  Native (MAGC1_HUMAN)
FFSYTLASLLQSSHESPQS

SEQ ID NO: 248417 - protein, 20 aa, Homo sapiens
  Native (MAGC1_HUMAN)
FFSYTLASLLQSSHESPQSP

SEQ ID NO: 248418 - protein, 21 aa, Homo sapiens
  Native (MAGC1_HUMAN)
FFSYTLASLLQSSHESPQSPP

SEQ ID NO: 248419 - protein, 22 aa, Homo sapiens
  Native (MAGC1_HUMAN)
FFSYTLASLLQSSHESPQSPPE

SEQ ID NO: 248420 - protein, 23 aa, Homo sapiens
  Native (MAGC1_HUMAN)
FFSYTLASLLQSSHESPQSPPEG

SEQ ID NO: 248421 - protein, 24 aa, Homo sapiens
  Native (MAGC1_HUMAN)
FFSYTLASLLQSSHESPQSPPEGP

SEQ ID NO: 248422 - protein, 25 aa, Homo sapiens
  Native (MAGC1_HUMAN)
FFSYTLASLLQSSHESPQSPPEGPA

SEQ ID NO: 248423 - protein, 15 aa, Homo sapiens
  Native (MAGC1_HUMAN)
FGEPRELLTKVWVQE

SEQ ID NO: 248424 - protein, 16 aa, Homo sapiens
  Native (MAGC1_HUMAN)
FGEPRELLTKVWVQEH

SEQ ID NO: 248425 - protein, 17 aa, Homo sapiens
  Native (MAGC1_HUMAN)
FGEPRELLTKVWVQEHY

SEQ ID NO: 248426 - protein, 18 aa, Homo sapiens
  Native (MAGC1_HUMAN)
FGEPRELLTKVWVQEHYL

SEQ ID NO: 248427 - protein, 19 aa, Homo sapiens
  Native (MAGC1_HUMAN)
FGEPRELLTKVWVQEHYLE

SEQ ID NO: 248428 - protein, 20 aa, Homo sapiens
  Native (MAGC1_HUMAN)
FGEPRELLTKVWVQEHYLEY

SEQ ID NO: 248429 - protein, 21 aa, Homo sapiens
  Native (MAGC1_HUMAN)
FGEPRELLTKVWVQEHYLEYR

SEQ ID NO: 248430 - protein, 22 aa, Homo sapiens
  Native (MAGC1_HUMAN)
FGEPRELLTKVWVQEHYLEYRE

SEQ ID NO: 248431 - protein, 23 aa, Homo sapiens
  Native (MAGC1_HUMAN)
FGEPRELLTKVWVQEHYLEYREV

SEQ ID NO: 248432 - protein, 24 aa, Homo sapiens
  Native (MAGC1_HUMAN)
FGEPRELLTKVWVQEHYLEYREVP

SEQ ID NO: 248433 - protein, 25 aa, Homo sapiens
  Native (MAGC1_HUMAN)
FGEPRELLTKVWVQEHYLEYREVPN

SEQ ID NO: 248434 - protein, 20 aa, Homo sapiens
  Native (MAGC1_HUMAN)
FGISLREVDPDDSYVFVNTL

SEQ ID NO: 248435 - protein, 22 aa, Homo sapiens
  Native (MAGC1_HUMAN)
FGISLREVDPDDSYVFVNTLDL

SEQ ID NO: 248436 - protein, 23 aa, Homo sapiens
  Native (MAGC1_HUMAN)
FGISLREVDPDDSYVFVNTLDLT

SEQ ID NO: 248437 - protein, 24 aa, Homo sapiens
  Native (MAGC1_HUMAN)
FGISLREVDPDDSYVFVNTLDLTS

SEQ ID NO: 248438 - protein, 25 aa, Homo sapiens
  Native (MAGC1_HUMAN)
FGISLREVDPDDSYVFVNTLDLTSE

SEQ ID NO: 248439 - protein, 13 aa, Homo sapiens
  Native (MAGC1_HUMAN)
FIEILFGISLREV

SEQ ID NO: 248440 - protein, 14 aa, Homo sapiens
  Native (MAGC1_HUMAN)
FIEILFGISLREVD

SEQ ID NO: 248441 - protein, 15 aa, Homo sapiens
  Native (MAGC1_HUMAN)
FIEILFGISLREVDP

SEQ ID NO: 248442 - protein, 16 aa, Homo sapiens
  Native (MAGC1_HUMAN)
FIEILFGISLREVDPD

SEQ ID NO: 248443 - protein, 17 aa, Homo sapiens
  Native (MAGC1_HUMAN)
FIEILFGISLREVDPDD

SEQ ID NO: 248444 - protein, 18 aa, Homo sapiens
  Native (MAGC1_HUMAN)
FIEILFGISLREVDPDDS

SEQ ID NO: 248445 - protein, 19 aa, Homo sapiens
  Native (MAGC1_HUMAN)
FIEILFGISLREVDPDDSY

SEQ ID NO: 248446 - protein, 20 aa, Homo sapiens
  Native (MAGC1_HUMAN)
FIEILFGISLREVDPDDSYV

SEQ ID NO: 248447 - protein, 21 aa, Homo sapiens
  Native (MAGC1_HUMAN)
FIEILFGISLREVDPDDSYVF

SEQ ID NO: 248448 - protein, 22 aa, Homo sapiens
  Native (MAGC1_HUMAN)
FIEILFGISLREVDPDDSYVFV

SEQ ID NO: 248449 - protein, 23 aa, Homo sapiens
  Native (MAGC1_HUMAN)
FIEILFGISLREVDPDDSYVFVN

SEQ ID NO: 248450 - protein, 24 aa, Homo sapiens
  Native (MAGC1_HUMAN)
FIEILFGISLREVDPDDSYVFVNT

SEQ ID NO: 248451 - protein, 25 aa, Homo sapiens
  Native (MAGC1_HUMAN)
FIEILFGISLREVDPDDSYVFVNTL

SEQ ID NO: 248452 - protein, 13 aa, Homo sapiens
  Native (MAGC1_HUMAN)
FIKGTYASEEVIW

SEQ ID NO: 248453 - protein, 14 aa, Homo sapiens
  Native (MAGC1_HUMAN)
FIKGTYASEEVIWD

SEQ ID NO: 248454 - protein, 15 aa, Homo sapiens
  Native (MAGC1_HUMAN)
FIKGTYASEEVIWDV

SEQ ID NO: 248455 - protein, 16 aa, Homo sapiens
  Native (MAGC1_HUMAN)
FIKGTYASEEVIWDVL

SEQ ID NO: 248456 - protein, 17 aa, Homo sapiens
  Native (MAGC1_HUMAN)
FIKGTYASEEVIWDVLS

SEQ ID NO: 248457 - protein, 18 aa, Homo sapiens
  Native (MAGC1_HUMAN)
FIKGTYASEEVIWDVLSG

SEQ ID NO: 248458 - protein, 19 aa, Homo sapiens
  Native (MAGC1_HUMAN)
FIKGTYASEEVIWDVLSGI

SEQ ID NO: 248459 - protein, 20 aa, Homo sapiens
  Native (MAGC1_HUMAN)
FIKGTYASEEVIWDVLSGIG

SEQ ID NO: 248460 - protein, 21 aa, Homo sapiens
  Native (MAGC1_HUMAN)
FIKGTYASEEVIWDVLSGIGV

SEQ ID NO: 248461 - protein, 22 aa, Homo sapiens
  Native (MAGC1_HUMAN)
FIKGTYASEEVIWDVLSGIGVR

SEQ ID NO: 248462 - protein, 23 aa, Homo sapiens
  Native (MAGC1_HUMAN)
FIKGTYASEEVIWDVLSGIGVRA

SEQ ID NO: 248463 - protein, 24 aa, Homo sapiens
  Native (MAGC1_HUMAN)
FIKGTYASEEVIWDVLSGIGVRAG

SEQ ID NO: 248464 - protein, 25 aa, Homo sapiens
  Native (MAGC1_HUMAN)
FIKGTYASEEVIWDVLSGIGVRAGR

SEQ ID NO: 248465 - protein, 13 aa, Homo sapiens
  Native (MAGC1_HUMAN)
FLAMLKNTVPITF

SEQ ID NO: 248466 - protein, 14 aa, Homo sapiens
  Native (MAGC1_HUMAN)
FLAMLKNTVPITFP

SEQ ID NO: 248467 - protein, 15 aa, Homo sapiens
  Native (MAGC1_HUMAN)
FLAMLKNTVPITFPS

SEQ ID NO: 248468 - protein, 16 aa, Homo sapiens
  Native (MAGC1_HUMAN)
FLAMLKNTVPITFPSS

SEQ ID NO: 248469 - protein, 17 aa, Homo sapiens
  Native (MAGC1_HUMAN)
FLAMLKNTVPITFPSSY

SEQ ID NO: 248470 - protein, 18 aa, Homo sapiens
  Native (MAGC1_HUMAN)
FLAMLKNTVPITFPSSYK

SEQ ID NO: 248471 - protein, 19 aa, Homo sapiens
  Native (MAGC1_HUMAN)
FLAMLKNTVPITFPSSYKD

SEQ ID NO: 248472 - protein, 20 aa, Homo sapiens
  Native (MAGC1_HUMAN)
FLAMLKNTVPITFPSSYKDA

SEQ ID NO: 248473 - protein, 21 aa, Homo sapiens
  Native (MAGC1_HUMAN)
FLAMLKNTVPITFPSSYKDAL

SEQ ID NO: 248474 - protein, 22 aa, Homo sapiens
  Native (MAGC1_HUMAN)
FLAMLKNTVPITFPSSYKDALK

SEQ ID NO: 248475 - protein, 23 aa, Homo sapiens
  Native (MAGC1_HUMAN)
FLAMLKNTVPITFPSSYKDALKD

SEQ ID NO: 248476 - protein, 24 aa, Homo sapiens
  Native (MAGC1_HUMAN)
FLAMLKNTVPITFPSSYKDALKDV

SEQ ID NO: 248477 - protein, 25 aa, Homo sapiens
  Native (MAGC1_HUMAN)
FLAMLKNTVPITFPSSYKDALKDVE

SEQ ID NO: 248478 - protein, 13 aa, Homo sapiens
  Native (MAGC1_HUMAN)
FLLLKYQVKQPIT

SEQ ID NO: 248479 - protein, 14 aa, Homo sapiens
  Native (MAGC1_HUMAN)
FLLLKYQVKQPITK

SEQ ID NO: 248480 - protein, 15 aa, Homo sapiens
  Native (MAGC1_HUMAN)
FLLLKYQVKQPITKA

SEQ ID NO: 248481 - protein, 16 aa, Homo sapiens
  Native (MAGC1_HUMAN)
FLLLKYQVKQPITKAE

SEQ ID NO: 248482 - protein, 17 aa, Homo sapiens
  Native (MAGC1_HUMAN)
FLLLKYQVKQPITKAEM

SEQ ID NO: 248483 - protein, 18 aa, Homo sapiens
  Native (MAGC1_HUMAN)
FLLLKYQVKQPITKAEML

SEQ ID NO: 248484 - protein, 19 aa, Homo sapiens
  Native (MAGC1_HUMAN)
FLLLKYQVKQPITKAEMLT

SEQ ID NO: 248485 - protein, 20 aa, Homo sapiens
  Native (MAGC1_HUMAN)
FLLLKYQVKQPITKAEMLTN

SEQ ID NO: 248486 - protein, 21 aa, Homo sapiens
  Native (MAGC1_HUMAN)
FLLLKYQVKQPITKAEMLTNV

SEQ ID NO: 248487 - protein, 22 aa, Homo sapiens
  Native (MAGC1_HUMAN)
FLLLKYQVKQPITKAEMLTNVI

SEQ ID NO: 248488 - protein, 23 aa, Homo sapiens
  Native (MAGC1_HUMAN)
FLLLKYQVKQPITKAEMLTNVIS

SEQ ID NO: 248489 - protein, 24 aa, Homo sapiens
  Native (MAGC1_HUMAN)
FLLLKYQVKQPITKAEMLTNVISR

SEQ ID NO: 248490 - protein, 25 aa, Homo sapiens
  Native (MAGC1_HUMAN)
FLLLKYQVKQPITKAEMLTNVISRY

SEQ ID NO: 248491 - protein, 16 aa, Homo sapiens
  Native (MAGC1_HUMAN)
FLWGPRAHSEVIKRKV

SEQ ID NO: 248492 - protein, 17 aa, Homo sapiens
  Native (MAGC1_HUMAN)
FLWGPRAHSEVIKRKVV

SEQ ID NO: 248493 - protein, 19 aa, Homo sapiens
  Native (MAGC1_HUMAN)
FLWGPRAHSEVIKRKVVEF

SEQ ID NO: 248494 - protein, 20 aa, Homo sapiens
  Native (MAGC1_HUMAN)
FLWGPRAHSEVIKRKVVEFL

SEQ ID NO: 248495 - protein, 21 aa, Homo sapiens
  Native (MAGC1_HUMAN)
FLWGPRAHSEVIKRKVVEFLA

SEQ ID NO: 248496 - protein, 22 aa, Homo sapiens
  Native (MAGC1_HUMAN)
FLWGPRAHSEVIKRKVVEFLAM

SEQ ID NO: 248497 - protein, 23 aa, Homo sapiens
  Native (MAGC1_HUMAN)
FLWGPRAHSEVIKRKVVEFLAML

SEQ ID NO: 248498 - protein, 24 aa, Homo sapiens
  Native (MAGC1_HUMAN)
FLWGPRAHSEVIKRKVVEFLAMLK

SEQ ID NO: 248499 - protein, 25 aa, Homo sapiens
  Native (MAGC1_HUMAN)
FLWGPRAHSEVIKRKVVEFLAMLKN

SEQ ID NO: 248500 - protein, 16 aa, Homo sapiens
  Native (MAGC1_HUMAN)
FPPQGEDFQSSLQSPV

SEQ ID NO: 248501 - protein, 17 aa, Homo sapiens
  Native (MAGC1_HUMAN)
FPPQGEDFQSSLQSPVS

SEQ ID NO: 248502 - protein, 18 aa, Homo sapiens
  Native (MAGC1_HUMAN)
FPPQGEDFQSSLQSPVSI

SEQ ID NO: 248503 - protein, 19 aa, Homo sapiens
  Native (MAGC1_HUMAN)
FPPQGEDFQSSLQSPVSIC

SEQ ID NO: 248504 - protein, 20 aa, Homo sapiens
  Native (MAGC1_HUMAN)
FPPQGEDFQSSLQSPVSICS

SEQ ID NO: 248505 - protein, 21 aa, Homo sapiens
  Native (MAGC1_HUMAN)
FPPQGEDFQSSLQSPVSICSS

SEQ ID NO: 248506 - protein, 22 aa, Homo sapiens
  Native (MAGC1_HUMAN)
FPPQGEDFQSSLQSPVSICSSS

SEQ ID NO: 248507 - protein, 23 aa, Homo sapiens
  Native (MAGC1_HUMAN)
FPPQGEDFQSSLQSPVSICSSST

SEQ ID NO: 248508 - protein, 24 aa, Homo sapiens
  Native (MAGC1_HUMAN)
FPPQGEDFQSSLQSPVSICSSSTS

SEQ ID NO: 248509 - protein, 25 aa, Homo sapiens
  Native (MAGC1_HUMAN)
FPPQGEDFQSSLQSPVSICSSSTSL

SEQ ID NO: 248510 - protein, 19 aa, Homo sapiens
  Native (MAGC1_HUMAN)
FPQFPPQGEDFQSSLQSPV

SEQ ID NO: 248511 - protein, 20 aa, Homo sapiens
  Native (MAGC1_HUMAN)
FPQFPPQGEDFQSSLQSPVS

SEQ ID NO: 248512 - protein, 21 aa, Homo sapiens
  Native (MAGC1_HUMAN)
FPQFPPQGEDFQSSLQSPVSI

SEQ ID NO: 248513 - protein, 22 aa, Homo sapiens
  Native (MAGC1_HUMAN)
FPQFPPQGEDFQSSLQSPVSIC

SEQ ID NO: 248514 - protein, 23 aa, Homo sapiens
  Native (MAGC1_HUMAN)
FPQFPPQGEDFQSSLQSPVSICS

SEQ ID NO: 248515 - protein, 24 aa, Homo sapiens
  Native (MAGC1_HUMAN)
FPQFPPQGEDFQSSLQSPVSICSS

SEQ ID NO: 248516 - protein, 25 aa, Homo sapiens
  Native (MAGC1_HUMAN)
FPQFPPQGEDFQSSLQSPVSICSSS

SEQ ID NO: 248517 - protein, 14 aa, Homo sapiens
  Native (MAGC1_HUMAN)
FPQSLLQIPMTSSF

SEQ ID NO: 248518 - protein, 15 aa, Homo sapiens
  Native (MAGC1_HUMAN)
FPQSLLQIPMTSSFS

SEQ ID NO: 248519 - protein, 16 aa, Homo sapiens
  Native (MAGC1_HUMAN)
FPQSLLQIPMTSSFSS

SEQ ID NO: 248520 - protein, 17 aa, Homo sapiens
  Native (MAGC1_HUMAN)
FPQSLLQIPMTSSFSST

SEQ ID NO: 248521 - protein, 18 aa, Homo sapiens
  Native (MAGC1_HUMAN)
FPQSLLQIPMTSSFSSTL

SEQ ID NO: 248522 - protein, 19 aa, Homo sapiens
  Native (MAGC1_HUMAN)
FPQSLLQIPMTSSFSSTLL

SEQ ID NO: 248523 - protein, 20 aa, Homo sapiens
  Native (MAGC1_HUMAN)
FPQSLLQIPMTSSFSSTLLS

SEQ ID NO: 248524 - protein, 21 aa, Homo sapiens
  Native (MAGC1_HUMAN)
FPQSLLQIPMTSSFSSTLLSI

SEQ ID NO: 248525 - protein, 22 aa, Homo sapiens
  Native (MAGC1_HUMAN)
FPQSLLQIPMTSSFSSTLLSIF

SEQ ID NO: 248526 - protein, 23 aa, Homo sapiens
  Native (MAGC1_HUMAN)
FPQSLLQIPMTSSFSSTLLSIFQ

SEQ ID NO: 248527 - protein, 24 aa, Homo sapiens
  Native (MAGC1_HUMAN)
FPQSLLQIPMTSSFSSTLLSIFQS

SEQ ID NO: 248528 - protein, 25 aa, Homo sapiens
  Native (MAGC1_HUMAN)
FPQSLLQIPMTSSFSSTLLSIFQSS

SEQ ID NO: 248529 - protein, 14 aa, Homo sapiens
  Native (MAGC1_HUMAN)
FPQSPLQGEEFQSS

SEQ ID NO: 248530 - protein, 15 aa, Homo sapiens
  Native (MAGC1_HUMAN)
FPQSPLQGEEFQSSL

SEQ ID NO: 248531 - protein, 16 aa, Homo sapiens
  Native (MAGC1_HUMAN)
FPQSPLQGEEFQSSLQ

SEQ ID NO: 248532 - protein, 17 aa, Homo sapiens
  Native (MAGC1_HUMAN)
FPQSPLQGEEFQSSLQS

SEQ ID NO: 248533 - protein, 18 aa, Homo sapiens
  Native (MAGC1_HUMAN)
FPQSPLQGEEFQSSLQSP

SEQ ID NO: 248534 - protein, 19 aa, Homo sapiens
  Native (MAGC1_HUMAN)
FPQSPLQGEEFQSSLQSPV

SEQ ID NO: 248535 - protein, 20 aa, Homo sapiens
  Native (MAGC1_HUMAN)
FPQSPLQGEEFQSSLQSPVS

SEQ ID NO: 248536 - protein, 21 aa, Homo sapiens
  Native (MAGC1_HUMAN)
FPQSPLQGEEFQSSLQSPVSI

SEQ ID NO: 248537 - protein, 22 aa, Homo sapiens
  Native (MAGC1_HUMAN)
FPQSPLQGEEFQSSLQSPVSIC

SEQ ID NO: 248538 - protein, 23 aa, Homo sapiens
  Native (MAGC1_HUMAN)
FPQSPLQGEEFQSSLQSPVSICS

SEQ ID NO: 248539 - protein, 24 aa, Homo sapiens
  Native (MAGC1_HUMAN)
FPQSPLQGEEFQSSLQSPVSICSS

SEQ ID NO: 248540 - protein, 25 aa, Homo sapiens
  Native (MAGC1_HUMAN)
FPQSPLQGEEFQSSLQSPVSICSSS

SEQ ID NO: 248541 - protein, 15 aa, Homo sapiens
  Native (MAGC1_HUMAN)
FPQSPLQIPGSPSFS

SEQ ID NO: 248542 - protein, 16 aa, Homo sapiens
  Native (MAGC1_HUMAN)
FPQSPLQIPGSPSFSS

SEQ ID NO: 248543 - protein, 17 aa, Homo sapiens
  Native (MAGC1_HUMAN)
FPQSPLQIPGSPSFSST

SEQ ID NO: 248544 - protein, 18 aa, Homo sapiens
  Native (MAGC1_HUMAN)
FPQSPLQIPGSPSFSSTL

SEQ ID NO: 248545 - protein, 19 aa, Homo sapiens
  Native (MAGC1_HUMAN)
FPQSPLQIPGSPSFSSTLL

SEQ ID NO: 248546 - protein, 20 aa, Homo sapiens
  Native (MAGC1_HUMAN)
FPQSPLQIPGSPSFSSTLLS

SEQ ID NO: 248547 - protein, 21 aa, Homo sapiens
  Native (MAGC1_HUMAN)
FPQSPLQIPGSPSFSSTLLSL

SEQ ID NO: 248548 - protein, 22 aa, Homo sapiens
  Native (MAGC1_HUMAN)
FPQSPLQIPGSPSFSSTLLSLF

SEQ ID NO: 248549 - protein, 23 aa, Homo sapiens
  Native (MAGC1_HUMAN)
FPQSPLQIPGSPSFSSTLLSLFQ

SEQ ID NO: 248550 - protein, 24 aa, Homo sapiens
  Native (MAGC1_HUMAN)
FPQSPLQIPGSPSFSSTLLSLFQS

SEQ ID NO: 248551 - protein, 25 aa, Homo sapiens
  Native (MAGC1_HUMAN)
FPQSPLQIPGSPSFSSTLLSLFQSS

SEQ ID NO: 248552 - protein, 15 aa, Homo sapiens
  Native (MAGC1_HUMAN)
FPQSPLQIPMTSSFS

SEQ ID NO: 248553 - protein, 16 aa, Homo sapiens
  Native (MAGC1_HUMAN)
FPQSPLQIPMTSSFSS

SEQ ID NO: 248554 - protein, 17 aa, Homo sapiens
  Native (MAGC1_HUMAN)
FPQSPLQIPMTSSFSST

SEQ ID NO: 248555 - protein, 19 aa, Homo sapiens
  Native (MAGC1_HUMAN)
FPQSPLQIPMTSSFSSTLL

SEQ ID NO: 248556 - protein, 20 aa, Homo sapiens
  Native (MAGC1_HUMAN)
FPQSPLQIPMTSSFSSTLLS

SEQ ID NO: 248557 - protein, 21 aa, Homo sapiens
  Native (MAGC1_HUMAN)
FPQSPLQIPMTSSFSSTLLSI

SEQ ID NO: 248558 - protein, 22 aa, Homo sapiens
  Native (MAGC1_HUMAN)
FPQSPLQIPMTSSFSSTLLSIL

SEQ ID NO: 248559 - protein, 23 aa, Homo sapiens
  Native (MAGC1_HUMAN)
FPQSPLQIPMTSSFSSTLLSILQ

SEQ ID NO: 248560 - protein, 24 aa, Homo sapiens
  Native (MAGC1_HUMAN)
FPQSPLQIPMTSSFSSTLLSILQS

SEQ ID NO: 248561 - protein, 25 aa, Homo sapiens
  Native (MAGC1_HUMAN)
FPQSPLQIPMTSSFSSTLLSILQSS

SEQ ID NO: 248562 - protein, 15 aa, Homo sapiens
  Native (MAGC1_HUMAN)
FPQSPLQIPVSRSFS

SEQ ID NO: 248563 - protein, 17 aa, Homo sapiens
  Native (MAGC1_HUMAN)
FPQSPLQIPVSRSFSST

SEQ ID NO: 248564 - protein, 19 aa, Homo sapiens
  Native (MAGC1_HUMAN)
FPQSPLQIPVSRSFSSTLL

SEQ ID NO: 248565 - protein, 20 aa, Homo sapiens
  Native (MAGC1_HUMAN)
FPQSPLQIPVSRSFSSTLLS

SEQ ID NO: 248566 - protein, 21 aa, Homo sapiens
  Native (MAGC1_HUMAN)
FPQSPLQIPVSRSFSSTLLSI

SEQ ID NO: 248567 - protein, 22 aa, Homo sapiens
  Native (MAGC1_HUMAN)
FPQSPLQIPVSRSFSSTLLSIF

SEQ ID NO: 248568 - protein, 23 aa, Homo sapiens
  Native (MAGC1_HUMAN)
FPQSPLQIPVSRSFSSTLLSIFQ

SEQ ID NO: 248569 - protein, 24 aa, Homo sapiens
  Native (MAGC1_HUMAN)
FPQSPLQIPVSRSFSSTLLSIFQS

SEQ ID NO: 248570 - protein, 25 aa, Homo sapiens
  Native (MAGC1_HUMAN)
FPQSPLQIPVSRSFSSTLLSIFQSS

SEQ ID NO: 248571 - protein, 15 aa, Homo sapiens
  Native (MAGC1_HUMAN)
FPQSPLQIPVSSSFS

SEQ ID NO: 248572 - protein, 17 aa, Homo sapiens
  Native (MAGC1_HUMAN)
FPQSPLQIPVSSSFSYT

SEQ ID NO: 248573 - protein, 19 aa, Homo sapiens
  Native (MAGC1_HUMAN)
FPQSPLQIPVSSSFSYTLL

SEQ ID NO: 248574 - protein, 20 aa, Homo sapiens
  Native (MAGC1_HUMAN)
FPQSPLQIPVSSSFSYTLLS

SEQ ID NO: 248575 - protein, 21 aa, Homo sapiens
  Native (MAGC1_HUMAN)
FPQSPLQIPVSSSFSYTLLSL

SEQ ID NO: 248576 - protein, 22 aa, Homo sapiens
  Native (MAGC1_HUMAN)
FPQSPLQIPVSSSFSYTLLSLF

SEQ ID NO: 248577 - protein, 23 aa, Homo sapiens
  Native (MAGC1_HUMAN)
FPQSPLQIPVSSSFSYTLLSLFQ

SEQ ID NO: 248578 - protein, 24 aa, Homo sapiens
  Native (MAGC1_HUMAN)
FPQSPLQIPVSSSFSYTLLSLFQS

SEQ ID NO: 248579 - protein, 25 aa, Homo sapiens
  Native (MAGC1_HUMAN)
FPQSPLQIPVSSSFSYTLLSLFQSS

SEQ ID NO: 248580 - protein, 17 aa, Homo sapiens
  Native (MAGC1_HUMAN)
FPQSPLQIPVSSSSSSS

SEQ ID NO: 248581 - protein, 18 aa, Homo sapiens
  Native (MAGC1_HUMAN)
FPQSPLQIPVSSSSSSST

SEQ ID NO: 248582 - protein, 19 aa, Homo sapiens
  Native (MAGC1_HUMAN)
FPQSPLQIPVSSSSSSSTL

SEQ ID NO: 248583 - protein, 20 aa, Homo sapiens
  Native (MAGC1_HUMAN)
FPQSPLQIPVSSSSSSSTLL

SEQ ID NO: 248584 - protein, 21 aa, Homo sapiens
  Native (MAGC1_HUMAN)
FPQSPLQIPVSSSSSSSTLLS

SEQ ID NO: 248585 - protein, 22 aa, Homo sapiens
  Native (MAGC1_HUMAN)
FPQSPLQIPVSSSSSSSTLLSL

SEQ ID NO: 248586 - protein, 23 aa, Homo sapiens
  Native (MAGC1_HUMAN)
FPQSPLQIPVSSSSSSSTLLSLF

SEQ ID NO: 248587 - protein, 24 aa, Homo sapiens
  Native (MAGC1_HUMAN)
FPQSPLQIPVSSSSSSSTLLSLFQ

SEQ ID NO: 248588 - protein, 25 aa, Homo sapiens
  Native (MAGC1_HUMAN)
FPQSPLQIPVSSSSSSSTLLSLFQS

SEQ ID NO: 248589 - protein, 17 aa, Homo sapiens
  Native (MAGC1_HUMAN)
FPQSPLQIPVSSSSSST

SEQ ID NO: 248590 - protein, 18 aa, Homo sapiens
  Native (MAGC1_HUMAN)
FPQSPLQIPVSSSSSSTL

SEQ ID NO: 248591 - protein, 19 aa, Homo sapiens
  Native (MAGC1_HUMAN)
FPQSPLQIPVSSSSSSTLL

SEQ ID NO: 248592 - protein, 20 aa, Homo sapiens
  Native (MAGC1_HUMAN)
FPQSPLQIPVSSSSSSTLLS

SEQ ID NO: 248593 - protein, 21 aa, Homo sapiens
  Native (MAGC1_HUMAN)
FPQSPLQIPVSSSSSSTLLSL

SEQ ID NO: 248594 - protein, 22 aa, Homo sapiens
  Native (MAGC1_HUMAN)
FPQSPLQIPVSSSSSSTLLSLF

SEQ ID NO: 248595 - protein, 23 aa, Homo sapiens
  Native (MAGC1_HUMAN)
FPQSPLQIPVSSSSSSTLLSLFQ

SEQ ID NO: 248596 - protein, 24 aa, Homo sapiens
  Native (MAGC1_HUMAN)
FPQSPLQIPVSSSSSSTLLSLFQS

SEQ ID NO: 248597 - protein, 25 aa, Homo sapiens
  Native (MAGC1_HUMAN)
FPQSPLQIPVSSSSSSTLLSLFQSS

SEQ ID NO: 248598 - protein, 20 aa, Homo sapiens
  Native (MAGC1_HUMAN)
FPQSPPEWEDSLSPLHFPQF

SEQ ID NO: 248599 - protein, 22 aa, Homo sapiens
  Native (MAGC1_HUMAN)
FPQSPPEWEDSLSPLHFPQFPP

SEQ ID NO: 248600 - protein, 23 aa, Homo sapiens
  Native (MAGC1_HUMAN)
FPQSPPEWEDSLSPLHFPQFPPQ

SEQ ID NO: 248601 - protein, 24 aa, Homo sapiens
  Native (MAGC1_HUMAN)
FPQSPPEWEDSLSPLHFPQFPPQG

SEQ ID NO: 248602 - protein, 25 aa, Homo sapiens
  Native (MAGC1_HUMAN)
FPQSPPEWEDSLSPLHFPQFPPQGE

SEQ ID NO: 248603 - protein, 24 aa, Homo sapiens
  Native (MAGC1_HUMAN)
FPQSPPQGEDSMSPLYFPQSPLQG

SEQ ID NO: 248604 - protein, 25 aa, Homo sapiens
  Native (MAGC1_HUMAN)
FPQSPPQGEDSMSPLYFPQSPLQGE

SEQ ID NO: 248605 - protein, 14 aa, Homo sapiens
  Native (MAGC1_HUMAN)
FPQSVLQIPVSAAS

SEQ ID NO: 248606 - protein, 15 aa, Homo sapiens
  Native (MAGC1_HUMAN)
FPQSVLQIPVSAASS

SEQ ID NO: 248607 - protein, 16 aa, Homo sapiens
  Native (MAGC1_HUMAN)
FPQSVLQIPVSAASSS

SEQ ID NO: 248608 - protein, 17 aa, Homo sapiens
  Native (MAGC1_HUMAN)
FPQSVLQIPVSAASSST

SEQ ID NO: 248609 - protein, 18 aa, Homo sapiens
  Native (MAGC1_HUMAN)
FPQSVLQIPVSAASSSTL

SEQ ID NO: 248610 - protein, 19 aa, Homo sapiens
  Native (MAGC1_HUMAN)
FPQSVLQIPVSAASSSTLV

SEQ ID NO: 248611 - protein, 20 aa, Homo sapiens
  Native (MAGC1_HUMAN)
FPQSVLQIPVSAASSSTLVS

SEQ ID NO: 248612 - protein, 21 aa, Homo sapiens
  Native (MAGC1_HUMAN)
FPQSVLQIPVSAASSSTLVSI

SEQ ID NO: 248613 - protein, 22 aa, Homo sapiens
  Native (MAGC1_HUMAN)
FPQSVLQIPVSAASSSTLVSIF

SEQ ID NO: 248614 - protein, 23 aa, Homo sapiens
  Native (MAGC1_HUMAN)
FPQSVLQIPVSAASSSTLVSIFQ

SEQ ID NO: 248615 - protein, 24 aa, Homo sapiens
  Native (MAGC1_HUMAN)
FPQSVLQIPVSAASSSTLVSIFQS

SEQ ID NO: 248616 - protein, 25 aa, Homo sapiens
  Native (MAGC1_HUMAN)
FPQSVLQIPVSAASSSTLVSIFQSS

SEQ ID NO: 248617 - protein, 13 aa, Homo sapiens
  Native (MAGC1_HUMAN)
FPSSTSSSLSKSS

SEQ ID NO: 248618 - protein, 14 aa, Homo sapiens
  Native (MAGC1_HUMAN)
FPSSTSSSLSKSSP

SEQ ID NO: 248619 - protein, 15 aa, Homo sapiens
  Native (MAGC1_HUMAN)
FPSSTSSSLSKSSPE

SEQ ID NO: 248620 - protein, 16 aa, Homo sapiens
  Native (MAGC1_HUMAN)
FPSSTSSSLSKSSPES

SEQ ID NO: 248621 - protein, 17 aa, Homo sapiens
  Native (MAGC1_HUMAN)
FPSSTSSSLSKSSPESP

SEQ ID NO: 248622 - protein, 18 aa, Homo sapiens
  Native (MAGC1_HUMAN)
FPSSTSSSLSKSSPESPL

SEQ ID NO: 248623 - protein, 19 aa, Homo sapiens
  Native (MAGC1_HUMAN)
FPSSTSSSLSKSSPESPLQ

SEQ ID NO: 248624 - protein, 20 aa, Homo sapiens
  Native (MAGC1_HUMAN)
FPSSTSSSLSKSSPESPLQS

SEQ ID NO: 248625 - protein, 21 aa, Homo sapiens
  Native (MAGC1_HUMAN)
FPSSTSSSLSKSSPESPLQSP

SEQ ID NO: 248626 - protein, 22 aa, Homo sapiens
  Native (MAGC1_HUMAN)
FPSSTSSSLSKSSPESPLQSPV

SEQ ID NO: 248627 - protein, 23 aa, Homo sapiens
  Native (MAGC1_HUMAN)
FPSSTSSSLSKSSPESPLQSPVI

SEQ ID NO: 248628 - protein, 24 aa, Homo sapiens
  Native (MAGC1_HUMAN)
FPSSTSSSLSKSSPESPLQSPVIS

SEQ ID NO: 248629 - protein, 25 aa, Homo sapiens
  Native (MAGC1_HUMAN)
FPSSTSSSLSKSSPESPLQSPVISF

SEQ ID NO: 248630 - protein, 13 aa, Homo sapiens
  Native (MAGC1_HUMAN)
FPSSTSSSLSQSS

SEQ ID NO: 248631 - protein, 14 aa, Homo sapiens
  Native (MAGC1_HUMAN)
FPSSTSSSLSQSSP

SEQ ID NO: 248632 - protein, 15 aa, Homo sapiens
  Native (MAGC1_HUMAN)
FPSSTSSSLSQSSPV

SEQ ID NO: 248633 - protein, 16 aa, Homo sapiens
  Native (MAGC1_HUMAN)
FPSSTSSSLSQSSPVS

SEQ ID NO: 248634 - protein, 17 aa, Homo sapiens
  Native (MAGC1_HUMAN)
FPSSTSSSLSQSSPVSS

SEQ ID NO: 248635 - protein, 18 aa, Homo sapiens
  Native (MAGC1_HUMAN)
FPSSTSSSLSQSSPVSSF

SEQ ID NO: 248636 - protein, 19 aa, Homo sapiens
  Native (MAGC1_HUMAN)
FPSSTSSSLSQSSPVSSFP

SEQ ID NO: 248637 - protein, 20 aa, Homo sapiens
  Native (MAGC1_HUMAN)
FPSSTSSSLSQSSPVSSFPS

SEQ ID NO: 248638 - protein, 21 aa, Homo sapiens
  Native (MAGC1_HUMAN)
FPSSTSSSLSQSSPVSSFPSS

SEQ ID NO: 248639 - protein, 22 aa, Homo sapiens
  Native (MAGC1_HUMAN)
FPSSTSSSLSQSSPVSSFPSST

SEQ ID NO: 248640 - protein, 23 aa, Homo sapiens
  Native (MAGC1_HUMAN)
FPSSTSSSLSQSSPVSSFPSSTS

SEQ ID NO: 248641 - protein, 24 aa, Homo sapiens
  Native (MAGC1_HUMAN)
FPSSTSSSLSQSSPVSSFPSSTSS

SEQ ID NO: 248642 - protein, 25 aa, Homo sapiens
  Native (MAGC1_HUMAN)
FPSSTSSSLSQSSPVSSFPSSTSSS

SEQ ID NO: 248643 - protein, 13 aa, Homo sapiens
  Native (MAGC1_HUMAN)
FPVIFRKAREFIE

SEQ ID NO: 248644 - protein, 14 aa, Homo sapiens
  Native (MAGC1_HUMAN)
FPVIFRKAREFIEI

SEQ ID NO: 248645 - protein, 16 aa, Homo sapiens
  Native (MAGC1_HUMAN)
FPVIFRKAREFIEILF

SEQ ID NO: 248646 - protein, 17 aa, Homo sapiens
  Native (MAGC1_HUMAN)
FPVIFRKAREFIEILFG

SEQ ID NO: 248647 - protein, 18 aa, Homo sapiens
  Native (MAGC1_HUMAN)
FPVIFRKAREFIEILFGI

SEQ ID NO: 248648 - protein, 19 aa, Homo sapiens
  Native (MAGC1_HUMAN)
FPVIFRKAREFIEILFGIS

SEQ ID NO: 248649 - protein, 20 aa, Homo sapiens
  Native (MAGC1_HUMAN)
FPVIFRKAREFIEILFGISL

SEQ ID NO: 248650 - protein, 21 aa, Homo sapiens
  Native (MAGC1_HUMAN)
FPVIFRKAREFIEILFGISLR

SEQ ID NO: 248651 - protein, 22 aa, Homo sapiens
  Native (MAGC1_HUMAN)
FPVIFRKAREFIEILFGISLRE

SEQ ID NO: 248652 - protein, 23 aa, Homo sapiens
  Native (MAGC1_HUMAN)
FPVIFRKAREFIEILFGISLREV

SEQ ID NO: 248653 - protein, 24 aa, Homo sapiens
  Native (MAGC1_HUMAN)
FPVIFRKAREFIEILFGISLREVD

SEQ ID NO: 248654 - protein, 25 aa, Homo sapiens
  Native (MAGC1_HUMAN)
FPVIFRKAREFIEILFGISLREVDP

SEQ ID NO: 248655 - protein, 15 aa, Homo sapiens
  Native (MAGC1_HUMAN)
FQSFSERTQSTFEGF

SEQ ID NO: 248656 - protein, 16 aa, Homo sapiens
  Native (MAGC1_HUMAN)
FQSFSERTQSTFEGFA

SEQ ID NO: 248657 - protein, 17 aa, Homo sapiens
  Native (MAGC1_HUMAN)
FQSFSERTQSTFEGFAQ

SEQ ID NO: 248658 - protein, 19 aa, Homo sapiens
  Native (MAGC1_HUMAN)
FQSFSERTQSTFEGFAQSS

SEQ ID NO: 248659 - protein, 20 aa, Homo sapiens
  Native (MAGC1_HUMAN)
FQSFSERTQSTFEGFAQSSL

SEQ ID NO: 248660 - protein, 21 aa, Homo sapiens
  Native (MAGC1_HUMAN)
FQSFSERTQSTFEGFAQSSLQ

SEQ ID NO: 248661 - protein, 22 aa, Homo sapiens
  Native (MAGC1_HUMAN)
FQSFSERTQSTFEGFAQSSLQI

SEQ ID NO: 248662 - protein, 23 aa, Homo sapiens
  Native (MAGC1_HUMAN)
FQSFSERTQSTFEGFAQSSLQIP

SEQ ID NO: 248663 - protein, 24 aa, Homo sapiens
  Native (MAGC1_HUMAN)
FQSFSERTQSTFEGFAQSSLQIPV

SEQ ID NO: 248664 - protein, 25 aa, Homo sapiens
  Native (MAGC1_HUMAN)
FQSFSERTQSTFEGFAQSSLQIPVS

SEQ ID NO: 248665 - protein, 15 aa, Homo sapiens
  Native (MAGC1_HUMAN)
FQSSLQSPVSICSSS

SEQ ID NO: 248666 - protein, 16 aa, Homo sapiens
  Native (MAGC1_HUMAN)
FQSSLQSPVSICSSST

SEQ ID NO: 248667 - protein, 17 aa, Homo sapiens
  Native (MAGC1_HUMAN)
FQSSLQSPVSICSSSTP

SEQ ID NO: 248668 - protein, 19 aa, Homo sapiens
  Native (MAGC1_HUMAN)
FQSSLQSPVSICSSSTPSS

SEQ ID NO: 248669 - protein, 20 aa, Homo sapiens
  Native (MAGC1_HUMAN)
FQSSLQSPVSICSSSTPSSL

SEQ ID NO: 248670 - protein, 21 aa, Homo sapiens
  Native (MAGC1_HUMAN)
FQSSLQSPVSICSSSTPSSLP

SEQ ID NO: 248671 - protein, 22 aa, Homo sapiens
  Native (MAGC1_HUMAN)
FQSSLQSPVSICSSSTPSSLPQ

SEQ ID NO: 248672 - protein, 23 aa, Homo sapiens
  Native (MAGC1_HUMAN)
FQSSLQSPVSICSSSTPSSLPQS

SEQ ID NO: 248673 - protein, 24 aa, Homo sapiens
  Native (MAGC1_HUMAN)
FQSSLQSPVSICSSSTPSSLPQSF

SEQ ID NO: 248674 - protein, 25 aa, Homo sapiens
  Native (MAGC1_HUMAN)
FQSSLQSPVSICSSSTPSSLPQSFP

SEQ ID NO: 248675 - protein, 17 aa, Homo sapiens
  Native (MAGC1_HUMAN)
FQSSLQSPVSICSSSTS

SEQ ID NO: 248676 - protein, 19 aa, Homo sapiens
  Native (MAGC1_HUMAN)
FQSSLQSPVSICSSSTSLS

SEQ ID NO: 248677 - protein, 20 aa, Homo sapiens
  Native (MAGC1_HUMAN)
FQSSLQSPVSICSSSTSLSL

SEQ ID NO: 248678 - protein, 21 aa, Homo sapiens
  Native (MAGC1_HUMAN)
FQSSLQSPVSICSSSTSLSLP

SEQ ID NO: 248679 - protein, 22 aa, Homo sapiens
  Native (MAGC1_HUMAN)
FQSSLQSPVSICSSSTSLSLPQ

SEQ ID NO: 248680 - protein, 23 aa, Homo sapiens
  Native (MAGC1_HUMAN)
FQSSLQSPVSICSSSTSLSLPQS

SEQ ID NO: 248681 - protein, 24 aa, Homo sapiens
  Native (MAGC1_HUMAN)
FQSSLQSPVSICSSSTSLSLPQSF

SEQ ID NO: 248682 - protein, 25 aa, Homo sapiens
  Native (MAGC1_HUMAN)
FQSSLQSPVSICSSSTSLSLPQSFP

SEQ ID NO: 248683 - protein, 20 aa, Homo sapiens
  Native (MAGC1_HUMAN)
FQSSPECTQSTFEGFPQSPL

SEQ ID NO: 248684 - protein, 21 aa, Homo sapiens
  Native (MAGC1_HUMAN)
FQSSPECTQSTFEGFPQSPLQ

SEQ ID NO: 248685 - protein, 22 aa, Homo sapiens
  Native (MAGC1_HUMAN)
FQSSPECTQSTFEGFPQSPLQI

SEQ ID NO: 248686 - protein, 23 aa, Homo sapiens
  Native (MAGC1_HUMAN)
FQSSPECTQSTFEGFPQSPLQIP

SEQ ID NO: 248687 - protein, 24 aa, Homo sapiens
  Native (MAGC1_HUMAN)
FQSSPECTQSTFEGFPQSPLQIPQ

SEQ ID NO: 248688 - protein, 25 aa, Homo sapiens
  Native (MAGC1_HUMAN)
FQSSPECTQSTFEGFPQSPLQIPQS

SEQ ID NO: 248689 - protein, 20 aa, Homo sapiens
  Native (MAGC1_HUMAN)
FQSSPERTHSTFEGFPQSLL

SEQ ID NO: 248690 - protein, 21 aa, Homo sapiens
  Native (MAGC1_HUMAN)
FQSSPERTHSTFEGFPQSLLQ

SEQ ID NO: 248691 - protein, 22 aa, Homo sapiens
  Native (MAGC1_HUMAN)
FQSSPERTHSTFEGFPQSLLQI

SEQ ID NO: 248692 - protein, 23 aa, Homo sapiens
  Native (MAGC1_HUMAN)
FQSSPERTHSTFEGFPQSLLQIP

SEQ ID NO: 248693 - protein, 24 aa, Homo sapiens
  Native (MAGC1_HUMAN)
FQSSPERTHSTFEGFPQSLLQIPM

SEQ ID NO: 248694 - protein, 25 aa, Homo sapiens
  Native (MAGC1_HUMAN)
FQSSPERTHSTFEGFPQSLLQIPMT

SEQ ID NO: 248695 - protein, 20 aa, Homo sapiens
  Native (MAGC1_HUMAN)
FQSSPERTHSTFEGFPQSPL

SEQ ID NO: 248696 - protein, 21 aa, Homo sapiens
  Native (MAGC1_HUMAN)
FQSSPERTHSTFEGFPQSPLQ

SEQ ID NO: 248697 - protein, 22 aa, Homo sapiens
  Native (MAGC1_HUMAN)
FQSSPERTHSTFEGFPQSPLQI

SEQ ID NO: 248698 - protein, 23 aa, Homo sapiens
  Native (MAGC1_HUMAN)
FQSSPERTHSTFEGFPQSPLQIP

SEQ ID NO: 248699 - protein, 24 aa, Homo sapiens
  Native (MAGC1_HUMAN)
FQSSPERTHSTFEGFPQSPLQIPM

SEQ ID NO: 248700 - protein, 25 aa, Homo sapiens
  Native (MAGC1_HUMAN)
FQSSPERTHSTFEGFPQSPLQIPMT

SEQ ID NO: 248701 - protein, 24 aa, Homo sapiens
  Native (MAGC1_HUMAN)
FQSSPERTHSTFEGFPQSPLQIPV

SEQ ID NO: 248702 - protein, 25 aa, Homo sapiens
  Native (MAGC1_HUMAN)
FQSSPERTHSTFEGFPQSPLQIPVS

SEQ ID NO: 248703 - protein, 16 aa, Homo sapiens
  Native (MAGC1_HUMAN)
FQSSPERTQSTFEGFA

SEQ ID NO: 248704 - protein, 17 aa, Homo sapiens
  Native (MAGC1_HUMAN)
FQSSPERTQSTFEGFAQ

SEQ ID NO: 248705 - protein, 19 aa, Homo sapiens
  Native (MAGC1_HUMAN)
FQSSPERTQSTFEGFAQSP

SEQ ID NO: 248706 - protein, 20 aa, Homo sapiens
  Native (MAGC1_HUMAN)
FQSSPERTQSTFEGFAQSPL

SEQ ID NO: 248707 - protein, 21 aa, Homo sapiens
  Native (MAGC1_HUMAN)
FQSSPERTQSTFEGFAQSPLQ

SEQ ID NO: 248708 - protein, 22 aa, Homo sapiens
  Native (MAGC1_HUMAN)
FQSSPERTQSTFEGFAQSPLQI

SEQ ID NO: 248709 - protein, 23 aa, Homo sapiens
  Native (MAGC1_HUMAN)
FQSSPERTQSTFEGFAQSPLQIP

SEQ ID NO: 248710 - protein, 24 aa, Homo sapiens
  Native (MAGC1_HUMAN)
FQSSPERTQSTFEGFAQSPLQIPV

SEQ ID NO: 248711 - protein, 25 aa, Homo sapiens
  Native (MAGC1_HUMAN)
FQSSPERTQSTFEGFAQSPLQIPVS

SEQ ID NO: 248712 - protein, 17 aa, Homo sapiens
  Native (MAGC1_HUMAN)
FQSSPERTQSTFEGFPQ

SEQ ID NO: 248713 - protein, 19 aa, Homo sapiens
  Native (MAGC1_HUMAN)
FQSSPERTQSTFEGFPQSP

SEQ ID NO: 248714 - protein, 20 aa, Homo sapiens
  Native (MAGC1_HUMAN)
FQSSPERTQSTFEGFPQSPL

SEQ ID NO: 248715 - protein, 21 aa, Homo sapiens
  Native (MAGC1_HUMAN)
FQSSPERTQSTFEGFPQSPLQ

SEQ ID NO: 248716 - protein, 22 aa, Homo sapiens
  Native (MAGC1_HUMAN)
FQSSPERTQSTFEGFPQSPLQI

SEQ ID NO: 248717 - protein, 23 aa, Homo sapiens
  Native (MAGC1_HUMAN)
FQSSPERTQSTFEGFPQSPLQIP

SEQ ID NO: 248718 - protein, 24 aa, Homo sapiens
  Native (MAGC1_HUMAN)
FQSSPERTQSTFEGFPQSPLQIPV

SEQ ID NO: 248719 - protein, 25 aa, Homo sapiens
  Native (MAGC1_HUMAN)
FQSSPERTQSTFEGFPQSPLQIPVS

SEQ ID NO: 248720 - protein, 20 aa, Homo sapiens
  Native (MAGC1_HUMAN)
FQSSPESAQSTFEGFPQSPL

SEQ ID NO: 248721 - protein, 21 aa, Homo sapiens
  Native (MAGC1_HUMAN)
FQSSPESAQSTFEGFPQSPLQ

SEQ ID NO: 248722 - protein, 22 aa, Homo sapiens
  Native (MAGC1_HUMAN)
FQSSPESAQSTFEGFPQSPLQI

SEQ ID NO: 248723 - protein, 23 aa, Homo sapiens
  Native (MAGC1_HUMAN)
FQSSPESAQSTFEGFPQSPLQIP

SEQ ID NO: 248724 - protein, 24 aa, Homo sapiens
  Native (MAGC1_HUMAN)
FQSSPESAQSTFEGFPQSPLQIPG

SEQ ID NO: 248725 - protein, 25 aa, Homo sapiens
  Native (MAGC1_HUMAN)
FQSSPESAQSTFEGFPQSPLQIPGS

SEQ ID NO: 248726 - protein, 22 aa, Homo sapiens
  Native (MAGC1_HUMAN)
FQSSPESTQSPFEGFPQSPLQI

SEQ ID NO: 248727 - protein, 23 aa, Homo sapiens
  Native (MAGC1_HUMAN)
FQSSPESTQSPFEGFPQSPLQIP

SEQ ID NO: 248728 - protein, 24 aa, Homo sapiens
  Native (MAGC1_HUMAN)
FQSSPESTQSPFEGFPQSPLQIPV

SEQ ID NO: 248729 - protein, 25 aa, Homo sapiens
  Native (MAGC1_HUMAN)
FQSSPESTQSPFEGFPQSPLQIPVS

SEQ ID NO: 248730 - protein, 20 aa, Homo sapiens
  Native (MAGC1_HUMAN)
FQSSPESTQSPFEGFPQSVL

SEQ ID NO: 248731 - protein, 22 aa, Homo sapiens
  Native (MAGC1_HUMAN)
FQSSPESTQSPFEGFPQSVLQI

SEQ ID NO: 248732 - protein, 23 aa, Homo sapiens
  Native (MAGC1_HUMAN)
FQSSPESTQSPFEGFPQSVLQIP

SEQ ID NO: 248733 - protein, 24 aa, Homo sapiens
  Native (MAGC1_HUMAN)
FQSSPESTQSPFEGFPQSVLQIPV

SEQ ID NO: 248734 - protein, 25 aa, Homo sapiens
  Native (MAGC1_HUMAN)
FQSSPESTQSPFEGFPQSVLQIPVS

SEQ ID NO: 248735 - protein, 13 aa, Homo sapiens
  Native (MAGC1_HUMAN)
FRKAREFIEILFG

SEQ ID NO: 248736 - protein, 14 aa, Homo sapiens
  Native (MAGC1_HUMAN)
FRKAREFIEILFGI

SEQ ID NO: 248737 - protein, 15 aa, Homo sapiens
  Native (MAGC1_HUMAN)
FRKAREFIEILFGIS

SEQ ID NO: 248738 - protein, 16 aa, Homo sapiens
  Native (MAGC1_HUMAN)
FRKAREFIEILFGISL

SEQ ID NO: 248739 - protein, 17 aa, Homo sapiens
  Native (MAGC1_HUMAN)
FRKAREFIEILFGISLR

SEQ ID NO: 248740 - protein, 18 aa, Homo sapiens
  Native (MAGC1_HUMAN)
FRKAREFIEILFGISLRE

SEQ ID NO: 248741 - protein, 19 aa, Homo sapiens
  Native (MAGC1_HUMAN)
FRKAREFIEILFGISLREV

SEQ ID NO: 248742 - protein, 20 aa, Homo sapiens
  Native (MAGC1_HUMAN)
FRKAREFIEILFGISLREVD

SEQ ID NO: 248743 - protein, 21 aa, Homo sapiens
  Native (MAGC1_HUMAN)
FRKAREFIEILFGISLREVDP

SEQ ID NO: 248744 - protein, 22 aa, Homo sapiens
  Native (MAGC1_HUMAN)
FRKAREFIEILFGISLREVDPD

SEQ ID NO: 248745 - protein, 23 aa, Homo sapiens
  Native (MAGC1_HUMAN)
FRKAREFIEILFGISLREVDPDD

SEQ ID NO: 248746 - protein, 24 aa, Homo sapiens
  Native (MAGC1_HUMAN)
FRKAREFIEILFGISLREVDPDDS

SEQ ID NO: 248747 - protein, 25 aa, Homo sapiens
  Native (MAGC1_HUMAN)
FRKAREFIEILFGISLREVDPDDSY

SEQ ID NO: 248748 - protein, 23 aa, Homo sapiens
  Native (MAGC1_HUMAN)
FSEESSSPVDEYTSSSDTLLESD

SEQ ID NO: 248749 - protein, 24 aa, Homo sapiens
  Native (MAGC1_HUMAN)
FSEESSSPVDEYTSSSDTLLESDS

SEQ ID NO: 248750 - protein, 25 aa, Homo sapiens
  Native (MAGC1_HUMAN)
FSEESSSPVDEYTSSSDTLLESDSL

SEQ ID NO: 248751 - protein, 14 aa, Homo sapiens
  Native (MAGC1_HUMAN)
FSERTQSTFEGFAQ

SEQ ID NO: 248752 - protein, 15 aa, Homo sapiens
  Native (MAGC1_HUMAN)
FSERTQSTFEGFAQS

SEQ ID NO: 248753 - protein, 16 aa, Homo sapiens
  Native (MAGC1_HUMAN)
FSERTQSTFEGFAQSS

SEQ ID NO: 248754 - protein, 17 aa, Homo sapiens
  Native (MAGC1_HUMAN)
FSERTQSTFEGFAQSSL

SEQ ID NO: 248755 - protein, 18 aa, Homo sapiens
  Native (MAGC1_HUMAN)
FSERTQSTFEGFAQSSLQ

SEQ ID NO: 248756 - protein, 19 aa, Homo sapiens
  Native (MAGC1_HUMAN)
FSERTQSTFEGFAQSSLQI

SEQ ID NO: 248757 - protein, 20 aa, Homo sapiens
  Native (MAGC1_HUMAN)
FSERTQSTFEGFAQSSLQIP

SEQ ID NO: 248758 - protein, 21 aa, Homo sapiens
  Native (MAGC1_HUMAN)
FSERTQSTFEGFAQSSLQIPV

SEQ ID NO: 248759 - protein, 22 aa, Homo sapiens
  Native (MAGC1_HUMAN)
FSERTQSTFEGFAQSSLQIPVS

SEQ ID NO: 248760 - protein, 23 aa, Homo sapiens
  Native (MAGC1_HUMAN)
FSERTQSTFEGFAQSSLQIPVSP

SEQ ID NO: 248761 - protein, 24 aa, Homo sapiens
  Native (MAGC1_HUMAN)
FSERTQSTFEGFAQSSLQIPVSPS

SEQ ID NO: 248762 - protein, 25 aa, Homo sapiens
  Native (MAGC1_HUMAN)
FSERTQSTFEGFAQSSLQIPVSPSF

SEQ ID NO: 248763 - protein, 13 aa, Homo sapiens
  Native (MAGC1_HUMAN)
FSSALLSIFQSSP

SEQ ID NO: 248764 - protein, 14 aa, Homo sapiens
  Native (MAGC1_HUMAN)
FSSALLSIFQSSPE

SEQ ID NO: 248765 - protein, 15 aa, Homo sapiens
  Native (MAGC1_HUMAN)
FSSALLSIFQSSPES

SEQ ID NO: 248766 - protein, 16 aa, Homo sapiens
  Native (MAGC1_HUMAN)
FSSALLSIFQSSPEST

SEQ ID NO: 248767 - protein, 17 aa, Homo sapiens
  Native (MAGC1_HUMAN)
FSSALLSIFQSSPESTQ

SEQ ID NO: 248768 - protein, 18 aa, Homo sapiens
  Native (MAGC1_HUMAN)
FSSALLSIFQSSPESTQS

SEQ ID NO: 248769 - protein, 19 aa, Homo sapiens
  Native (MAGC1_HUMAN)
FSSALLSIFQSSPESTQSP

SEQ ID NO: 248770 - protein, 20 aa, Homo sapiens
  Native (MAGC1_HUMAN)
FSSALLSIFQSSPESTQSPF

SEQ ID NO: 248771 - protein, 21 aa, Homo sapiens
  Native (MAGC1_HUMAN)
FSSALLSIFQSSPESTQSPFE

SEQ ID NO: 248772 - protein, 22 aa, Homo sapiens
  Native (MAGC1_HUMAN)
FSSALLSIFQSSPESTQSPFEG

SEQ ID NO: 248773 - protein, 23 aa, Homo sapiens
  Native (MAGC1_HUMAN)
FSSALLSIFQSSPESTQSPFEGF

SEQ ID NO: 248774 - protein, 24 aa, Homo sapiens
  Native (MAGC1_HUMAN)
FSSALLSIFQSSPESTQSPFEGFP

SEQ ID NO: 248775 - protein, 25 aa, Homo sapiens
  Native (MAGC1_HUMAN)
FSSALLSIFQSSPESTQSPFEGFPQ

SEQ ID NO: 248776 - protein, 14 aa, Homo sapiens
  Native (MAGC1_HUMAN)
FSSSTSLSPFSEES

SEQ ID NO: 248777 - protein, 15 aa, Homo sapiens
  Native (MAGC1_HUMAN)
FSSSTSLSPFSEESS

SEQ ID NO: 248778 - protein, 16 aa, Homo sapiens
  Native (MAGC1_HUMAN)
FSSSTSLSPFSEESSS

SEQ ID NO: 248779 - protein, 17 aa, Homo sapiens
  Native (MAGC1_HUMAN)
FSSSTSLSPFSEESSSP

SEQ ID NO: 248780 - protein, 20 aa, Homo sapiens
  Native (MAGC1_HUMAN)
FSSSTSLSPFSEESSSPVDE

SEQ ID NO: 248781 - protein, 13 aa, Homo sapiens
  Native (MAGC1_HUMAN)
FSSTLLSIFQSSP

SEQ ID NO: 248782 - protein, 14 aa, Homo sapiens
  Native (MAGC1_HUMAN)
FSSTLLSIFQSSPE

SEQ ID NO: 248783 - protein, 15 aa, Homo sapiens
  Native (MAGC1_HUMAN)
FSSTLLSIFQSSPER

SEQ ID NO: 248784 - protein, 16 aa, Homo sapiens
  Native (MAGC1_HUMAN)
FSSTLLSIFQSSPERT

SEQ ID NO: 248785 - protein, 17 aa, Homo sapiens
  Native (MAGC1_HUMAN)
FSSTLLSIFQSSPERTQ

SEQ ID NO: 248786 - protein, 18 aa, Homo sapiens
  Native (MAGC1_HUMAN)
FSSTLLSIFQSSPERTQS

SEQ ID NO: 248787 - protein, 19 aa, Homo sapiens
  Native (MAGC1_HUMAN)
FSSTLLSIFQSSPERTQST

SEQ ID NO: 248788 - protein, 20 aa, Homo sapiens
  Native (MAGC1_HUMAN)
FSSTLLSIFQSSPERTQSTF

SEQ ID NO: 248789 - protein, 21 aa, Homo sapiens
  Native (MAGC1_HUMAN)
FSSTLLSIFQSSPERTQSTFE

SEQ ID NO: 248790 - protein, 22 aa, Homo sapiens
  Native (MAGC1_HUMAN)
FSSTLLSIFQSSPERTQSTFEG

SEQ ID NO: 248791 - protein, 23 aa, Homo sapiens
  Native (MAGC1_HUMAN)
FSSTLLSIFQSSPERTQSTFEGF

SEQ ID NO: 248792 - protein, 24 aa, Homo sapiens
  Native (MAGC1_HUMAN)
FSSTLLSIFQSSPERTQSTFEGFA

SEQ ID NO: 248793 - protein, 25 aa, Homo sapiens
  Native (MAGC1_HUMAN)
FSSTLLSIFQSSPERTQSTFEGFAQ

SEQ ID NO: 248794 - protein, 15 aa, Homo sapiens
  Native (MAGC1_HUMAN)
FSSTLLSIFQSSPES

SEQ ID NO: 248795 - protein, 16 aa, Homo sapiens
  Native (MAGC1_HUMAN)
FSSTLLSIFQSSPESA

SEQ ID NO: 248796 - protein, 17 aa, Homo sapiens
  Native (MAGC1_HUMAN)
FSSTLLSIFQSSPESAQ

SEQ ID NO: 248797 - protein, 18 aa, Homo sapiens
  Native (MAGC1_HUMAN)
FSSTLLSIFQSSPESAQS

SEQ ID NO: 248798 - protein, 19 aa, Homo sapiens
  Native (MAGC1_HUMAN)
FSSTLLSIFQSSPESAQST

SEQ ID NO: 248799 - protein, 20 aa, Homo sapiens
  Native (MAGC1_HUMAN)
FSSTLLSIFQSSPESAQSTF

SEQ ID NO: 248800 - protein, 21 aa, Homo sapiens
  Native (MAGC1_HUMAN)
FSSTLLSIFQSSPESAQSTFE

SEQ ID NO: 248801 - protein, 22 aa, Homo sapiens
  Native (MAGC1_HUMAN)
FSSTLLSIFQSSPESAQSTFEG

SEQ ID NO: 248802 - protein, 23 aa, Homo sapiens
  Native (MAGC1_HUMAN)
FSSTLLSIFQSSPESAQSTFEGF

SEQ ID NO: 248803 - protein, 24 aa, Homo sapiens
  Native (MAGC1_HUMAN)
FSSTLLSIFQSSPESAQSTFEGFP

SEQ ID NO: 248804 - protein, 25 aa, Homo sapiens
  Native (MAGC1_HUMAN)
FSSTLLSIFQSSPESAQSTFEGFPQ

SEQ ID NO: 248805 - protein, 13 aa, Homo sapiens
  Native (MAGC1_HUMAN)
FSSTLLSILQSSP

SEQ ID NO: 248806 - protein, 14 aa, Homo sapiens
  Native (MAGC1_HUMAN)
FSSTLLSILQSSPE

SEQ ID NO: 248807 - protein, 15 aa, Homo sapiens
  Native (MAGC1_HUMAN)
FSSTLLSILQSSPES

SEQ ID NO: 248808 - protein, 16 aa, Homo sapiens
  Native (MAGC1_HUMAN)
FSSTLLSILQSSPESA

SEQ ID NO: 248809 - protein, 17 aa, Homo sapiens
  Native (MAGC1_HUMAN)
FSSTLLSILQSSPESAQ

SEQ ID NO: 248810 - protein, 18 aa, Homo sapiens
  Native (MAGC1_HUMAN)
FSSTLLSILQSSPESAQS

SEQ ID NO: 248811 - protein, 19 aa, Homo sapiens
  Native (MAGC1_HUMAN)
FSSTLLSILQSSPESAQSA

SEQ ID NO: 248812 - protein, 20 aa, Homo sapiens
  Native (MAGC1_HUMAN)
FSSTLLSILQSSPESAQSAF

SEQ ID NO: 248813 - protein, 21 aa, Homo sapiens
  Native (MAGC1_HUMAN)
FSSTLLSILQSSPESAQSAFE

SEQ ID NO: 248814 - protein, 22 aa, Homo sapiens
  Native (MAGC1_HUMAN)
FSSTLLSILQSSPESAQSAFEG

SEQ ID NO: 248815 - protein, 23 aa, Homo sapiens
  Native (MAGC1_HUMAN)
FSSTLLSILQSSPESAQSAFEGF

SEQ ID NO: 248816 - protein, 24 aa, Homo sapiens
  Native (MAGC1_HUMAN)
FSSTLLSILQSSPESAQSAFEGFP

SEQ ID NO: 248817 - protein, 25 aa, Homo sapiens
  Native (MAGC1_HUMAN)
FSSTLLSILQSSPESAQSAFEGFPQ

SEQ ID NO: 248818 - protein, 13 aa, Homo sapiens
  Native (MAGC1_HUMAN)
FSSTLLSLFQSSP

SEQ ID NO: 248819 - protein, 14 aa, Homo sapiens
  Native (MAGC1_HUMAN)
FSSTLLSLFQSSPE

SEQ ID NO: 248820 - protein, 15 aa, Homo sapiens
  Native (MAGC1_HUMAN)
FSSTLLSLFQSSPER

SEQ ID NO: 248821 - protein, 16 aa, Homo sapiens
  Native (MAGC1_HUMAN)
FSSTLLSLFQSSPERT

SEQ ID NO: 248822 - protein, 17 aa, Homo sapiens
  Native (MAGC1_HUMAN)
FSSTLLSLFQSSPERTH

SEQ ID NO: 248823 - protein, 18 aa, Homo sapiens
  Native (MAGC1_HUMAN)
FSSTLLSLFQSSPERTHS

SEQ ID NO: 248824 - protein, 19 aa, Homo sapiens
  Native (MAGC1_HUMAN)
FSSTLLSLFQSSPERTHST

SEQ ID NO: 248825 - protein, 20 aa, Homo sapiens
  Native (MAGC1_HUMAN)
FSSTLLSLFQSSPERTHSTF

SEQ ID NO: 248826 - protein, 21 aa, Homo sapiens
  Native (MAGC1_HUMAN)
FSSTLLSLFQSSPERTHSTFE

SEQ ID NO: 248827 - protein, 22 aa, Homo sapiens
  Native (MAGC1_HUMAN)
FSSTLLSLFQSSPERTHSTFEG

SEQ ID NO: 248828 - protein, 23 aa, Homo sapiens
  Native (MAGC1_HUMAN)
FSSTLLSLFQSSPERTHSTFEGF

SEQ ID NO: 248829 - protein, 24 aa, Homo sapiens
  Native (MAGC1_HUMAN)
FSSTLLSLFQSSPERTHSTFEGFP

SEQ ID NO: 248830 - protein, 25 aa, Homo sapiens
  Native (MAGC1_HUMAN)
FSSTLLSLFQSSPERTHSTFEGFPQ

SEQ ID NO: 248831 - protein, 13 aa, Homo sapiens
  Native (MAGC1_HUMAN)
FSSTLVSLFQSSP

SEQ ID NO: 248832 - protein, 14 aa, Homo sapiens
  Native (MAGC1_HUMAN)
FSSTLVSLFQSSPE

SEQ ID NO: 248833 - protein, 15 aa, Homo sapiens
  Native (MAGC1_HUMAN)
FSSTLVSLFQSSPER

SEQ ID NO: 248834 - protein, 16 aa, Homo sapiens
  Native (MAGC1_HUMAN)
FSSTLVSLFQSSPERT

SEQ ID NO: 248835 - protein, 17 aa, Homo sapiens
  Native (MAGC1_HUMAN)
FSSTLVSLFQSSPERTQ

SEQ ID NO: 248836 - protein, 18 aa, Homo sapiens
  Native (MAGC1_HUMAN)
FSSTLVSLFQSSPERTQS

SEQ ID NO: 248837 - protein, 19 aa, Homo sapiens
  Native (MAGC1_HUMAN)
FSSTLVSLFQSSPERTQST

SEQ ID NO: 248838 - protein, 20 aa, Homo sapiens
  Native (MAGC1_HUMAN)
FSSTLVSLFQSSPERTQSTF

SEQ ID NO: 248839 - protein, 21 aa, Homo sapiens
  Native (MAGC1_HUMAN)
FSSTLVSLFQSSPERTQSTFE

SEQ ID NO: 248840 - protein, 22 aa, Homo sapiens
  Native (MAGC1_HUMAN)
FSSTLVSLFQSSPERTQSTFEG

SEQ ID NO: 248841 - protein, 23 aa, Homo sapiens
  Native (MAGC1_HUMAN)
FSSTLVSLFQSSPERTQSTFEGF

SEQ ID NO: 248842 - protein, 24 aa, Homo sapiens
  Native (MAGC1_HUMAN)
FSSTLVSLFQSSPERTQSTFEGFP

SEQ ID NO: 248843 - protein, 25 aa, Homo sapiens
  Native (MAGC1_HUMAN)
FSSTLVSLFQSSPERTQSTFEGFPQ

SEQ ID NO: 248844 - protein, 13 aa, Homo sapiens
  Native (MAGC1_HUMAN)
FSYTLASLLQSSH

SEQ ID NO: 248845 - protein, 14 aa, Homo sapiens
  Native (MAGC1_HUMAN)
FSYTLASLLQSSHE

SEQ ID NO: 248846 - protein, 15 aa, Homo sapiens
  Native (MAGC1_HUMAN)
FSYTLASLLQSSHES

SEQ ID NO: 248847 - protein, 16 aa, Homo sapiens
  Native (MAGC1_HUMAN)
FSYTLASLLQSSHESP

SEQ ID NO: 248848 - protein, 17 aa, Homo sapiens
  Native (MAGC1_HUMAN)
FSYTLASLLQSSHESPQ

SEQ ID NO: 248849 - protein, 18 aa, Homo sapiens
  Native (MAGC1_HUMAN)
FSYTLASLLQSSHESPQS

SEQ ID NO: 248850 - protein, 19 aa, Homo sapiens
  Native (MAGC1_HUMAN)
FSYTLASLLQSSHESPQSP

SEQ ID NO: 248851 - protein, 20 aa, Homo sapiens
  Native (MAGC1_HUMAN)
FSYTLASLLQSSHESPQSPP

SEQ ID NO: 248852 - protein, 21 aa, Homo sapiens
  Native (MAGC1_HUMAN)
FSYTLASLLQSSHESPQSPPE

SEQ ID NO: 248853 - protein, 22 aa, Homo sapiens
  Native (MAGC1_HUMAN)
FSYTLASLLQSSHESPQSPPEG

SEQ ID NO: 248854 - protein, 23 aa, Homo sapiens
  Native (MAGC1_HUMAN)
FSYTLASLLQSSHESPQSPPEGP

SEQ ID NO: 248855 - protein, 24 aa, Homo sapiens
  Native (MAGC1_HUMAN)
FSYTLASLLQSSHESPQSPPEGPA

SEQ ID NO: 248856 - protein, 25 aa, Homo sapiens
  Native (MAGC1_HUMAN)
FSYTLASLLQSSHESPQSPPEGPAQ

SEQ ID NO: 248857 - protein, 13 aa, Homo sapiens
  Native (MAGC1_HUMAN)
FSYTLLSLFQSSP

SEQ ID NO: 248858 - protein, 14 aa, Homo sapiens
  Native (MAGC1_HUMAN)
FSYTLLSLFQSSPE

SEQ ID NO: 248859 - protein, 15 aa, Homo sapiens
  Native (MAGC1_HUMAN)
FSYTLLSLFQSSPER

SEQ ID NO: 248860 - protein, 16 aa, Homo sapiens
  Native (MAGC1_HUMAN)
FSYTLLSLFQSSPERT

SEQ ID NO: 248861 - protein, 17 aa, Homo sapiens
  Native (MAGC1_HUMAN)
FSYTLLSLFQSSPERTH

SEQ ID NO: 248862 - protein, 18 aa, Homo sapiens
  Native (MAGC1_HUMAN)
FSYTLLSLFQSSPERTHS

SEQ ID NO: 248863 - protein, 19 aa, Homo sapiens
  Native (MAGC1_HUMAN)
FSYTLLSLFQSSPERTHST

SEQ ID NO: 248864 - protein, 20 aa, Homo sapiens
  Native (MAGC1_HUMAN)
FSYTLLSLFQSSPERTHSTF

SEQ ID NO: 248865 - protein, 21 aa, Homo sapiens
  Native (MAGC1_HUMAN)
FSYTLLSLFQSSPERTHSTFE

SEQ ID NO: 248866 - protein, 22 aa, Homo sapiens
  Native (MAGC1_HUMAN)
FSYTLLSLFQSSPERTHSTFEG

SEQ ID NO: 248867 - protein, 23 aa, Homo sapiens
  Native (MAGC1_HUMAN)
FSYTLLSLFQSSPERTHSTFEGF

SEQ ID NO: 248868 - protein, 24 aa, Homo sapiens
  Native (MAGC1_HUMAN)
FSYTLLSLFQSSPERTHSTFEGFP

SEQ ID NO: 248869 - protein, 25 aa, Homo sapiens
  Native (MAGC1_HUMAN)
FSYTLLSLFQSSPERTHSTFEGFPQ

SEQ ID NO: 248870 - protein, 14 aa, Homo sapiens
  Native (MAGC1_HUMAN)
FTYTLDEKVDELAR

SEQ ID NO: 248871 - protein, 15 aa, Homo sapiens
  Native (MAGC1_HUMAN)
FTYTLDEKVDELARF

SEQ ID NO: 248872 - protein, 16 aa, Homo sapiens
  Native (MAGC1_HUMAN)
FTYTLDEKVDELARFL

SEQ ID NO: 248873 - protein, 17 aa, Homo sapiens
  Native (MAGC1_HUMAN)
FTYTLDEKVDELARFLL

SEQ ID NO: 248874 - protein, 18 aa, Homo sapiens
  Native (MAGC1_HUMAN)
FTYTLDEKVDELARFLLL

SEQ ID NO: 248875 - protein, 19 aa, Homo sapiens
  Native (MAGC1_HUMAN)
FTYTLDEKVDELARFLLLK

SEQ ID NO: 248876 - protein, 20 aa, Homo sapiens
  Native (MAGC1_HUMAN)
FTYTLDEKVDELARFLLLKY

SEQ ID NO: 248877 - protein, 21 aa, Homo sapiens
  Native (MAGC1_HUMAN)
FTYTLDEKVDELARFLLLKYQ

SEQ ID NO: 248878 - protein, 22 aa, Homo sapiens
  Native (MAGC1_HUMAN)
FTYTLDEKVDELARFLLLKYQV

SEQ ID NO: 248879 - protein, 23 aa, Homo sapiens
  Native (MAGC1_HUMAN)
FTYTLDEKVDELARFLLLKYQVK

SEQ ID NO: 248880 - protein, 24 aa, Homo sapiens
  Native (MAGC1_HUMAN)
FTYTLDEKVDELARFLLLKYQVKQ

SEQ ID NO: 248881 - protein, 25 aa, Homo sapiens
  Native (MAGC1_HUMAN)
FTYTLDEKVDELARFLLLKYQVKQP

SEQ ID NO: 248882 - protein, 17 aa, Homo sapiens
  Native (MAGC1_HUMAN)
GCLSDEQGMSQNRLLIL

SEQ ID NO: 248883 - protein, 18 aa, Homo sapiens
  Native (MAGC1_HUMAN)
GCLSDEQGMSQNRLLILI

SEQ ID NO: 248884 - protein, 19 aa, Homo sapiens
  Native (MAGC1_HUMAN)
GCLSDEQGMSQNRLLILIL

SEQ ID NO: 248885 - protein, 20 aa, Homo sapiens
  Native (MAGC1_HUMAN)
GCLSDEQGMSQNRLLILILS

SEQ ID NO: 248886 - protein, 21 aa, Homo sapiens
  Native (MAGC1_HUMAN)
GCLSDEQGMSQNRLLILILSI

SEQ ID NO: 248887 - protein, 22 aa, Homo sapiens
  Native (MAGC1_HUMAN)
GCLSDEQGMSQNRLLILILSII

SEQ ID NO: 248888 - protein, 23 aa, Homo sapiens
  Native (MAGC1_HUMAN)
GCLSDEQGMSQNRLLILILSIIF

SEQ ID NO: 248889 - protein, 24 aa, Homo sapiens
  Native (MAGC1_HUMAN)
GCLSDEQGMSQNRLLILILSIIFI

SEQ ID NO: 248890 - protein, 25 aa, Homo sapiens
  Native (MAGC1_HUMAN)
GCLSDEQGMSQNRLLILILSIIFIK

SEQ ID NO: 248891 - protein, 14 aa, Homo sapiens
  Native (MAGC1_HUMAN)
GDKDMPTAGMPSLL

SEQ ID NO: 248892 - protein, 15 aa, Homo sapiens
  Native (MAGC1_HUMAN)
GDKDMPTAGMPSLLQ

SEQ ID NO: 248893 - protein, 16 aa, Homo sapiens
  Native (MAGC1_HUMAN)
GDKDMPTAGMPSLLQS

SEQ ID NO: 248894 - protein, 17 aa, Homo sapiens
  Native (MAGC1_HUMAN)
GDKDMPTAGMPSLLQSS

SEQ ID NO: 248895 - protein, 18 aa, Homo sapiens
  Native (MAGC1_HUMAN)
GDKDMPTAGMPSLLQSSS

SEQ ID NO: 248896 - protein, 19 aa, Homo sapiens
  Native (MAGC1_HUMAN)
GDKDMPTAGMPSLLQSSSE

SEQ ID NO: 248897 - protein, 20 aa, Homo sapiens
  Native (MAGC1_HUMAN)
GDKDMPTAGMPSLLQSSSES

SEQ ID NO: 248898 - protein, 21 aa, Homo sapiens
  Native (MAGC1_HUMAN)
GDKDMPTAGMPSLLQSSSESP

SEQ ID NO: 248899 - protein, 22 aa, Homo sapiens
  Native (MAGC1_HUMAN)
GDKDMPTAGMPSLLQSSSESPQ

SEQ ID NO: 248900 - protein, 23 aa, Homo sapiens
  Native (MAGC1_HUMAN)
GDKDMPTAGMPSLLQSSSESPQS

SEQ ID NO: 248901 - protein, 24 aa, Homo sapiens
  Native (MAGC1_HUMAN)
GDKDMPTAGMPSLLQSSSESPQSC

SEQ ID NO: 248902 - protein, 25 aa, Homo sapiens
  Native (MAGC1_HUMAN)
GDKDMPTAGMPSLLQSSSESPQSCP

SEQ ID NO: 248903 - protein, 14 aa, Homo sapiens
  Native (MAGC1_HUMAN)
GEDFQSSLQSPVSI

SEQ ID NO: 248904 - protein, 15 aa, Homo sapiens
  Native (MAGC1_HUMAN)
GEDFQSSLQSPVSIC

SEQ ID NO: 248905 - protein, 16 aa, Homo sapiens
  Native (MAGC1_HUMAN)
GEDFQSSLQSPVSICS

SEQ ID NO: 248906 - protein, 17 aa, Homo sapiens
  Native (MAGC1_HUMAN)
GEDFQSSLQSPVSICSS

SEQ ID NO: 248907 - protein, 19 aa, Homo sapiens
  Native (MAGC1_HUMAN)
GEDFQSSLQSPVSICSSST

SEQ ID NO: 248908 - protein, 20 aa, Homo sapiens
  Native (MAGC1_HUMAN)
GEDFQSSLQSPVSICSSSTS

SEQ ID NO: 248909 - protein, 21 aa, Homo sapiens
  Native (MAGC1_HUMAN)
GEDFQSSLQSPVSICSSSTSL

SEQ ID NO: 248910 - protein, 22 aa, Homo sapiens
  Native (MAGC1_HUMAN)
GEDFQSSLQSPVSICSSSTSLS

SEQ ID NO: 248911 - protein, 23 aa, Homo sapiens
  Native (MAGC1_HUMAN)
GEDFQSSLQSPVSICSSSTSLSL

SEQ ID NO: 248912 - protein, 24 aa, Homo sapiens
  Native (MAGC1_HUMAN)
GEDFQSSLQSPVSICSSSTSLSLP

SEQ ID NO: 248913 - protein, 25 aa, Homo sapiens
  Native (MAGC1_HUMAN)
GEDFQSSLQSPVSICSSSTSLSLPQ

SEQ ID NO: 248914 - protein, 15 aa, Homo sapiens
  Native (MAGC1_HUMAN)
GEDSLSPLQIPQSPL

SEQ ID NO: 248915 - protein, 16 aa, Homo sapiens
  Native (MAGC1_HUMAN)
GEDSLSPLQIPQSPLE

SEQ ID NO: 248916 - protein, 17 aa, Homo sapiens
  Native (MAGC1_HUMAN)
GEDSLSPLQIPQSPLEG

SEQ ID NO: 248917 - protein, 20 aa, Homo sapiens
  Native (MAGC1_HUMAN)
GEDSLSPLQIPQSPLEGEDS

SEQ ID NO: 248918 - protein, 23 aa, Homo sapiens
  Native (MAGC1_HUMAN)
GEDSLSPLQIPQSPLEGEDSLSS

SEQ ID NO: 248919 - protein, 24 aa, Homo sapiens
  Native (MAGC1_HUMAN)
GEDSLSPLQIPQSPLEGEDSLSSL

SEQ ID NO: 248920 - protein, 25 aa, Homo sapiens
  Native (MAGC1_HUMAN)
GEDSLSPLQIPQSPLEGEDSLSSLH

SEQ ID NO: 248921 - protein, 14 aa, Homo sapiens
  Native (MAGC1_HUMAN)
GEDSLSSLHFPQSP

SEQ ID NO: 248922 - protein, 15 aa, Homo sapiens
  Native (MAGC1_HUMAN)
GEDSLSSLHFPQSPP

SEQ ID NO: 248923 - protein, 16 aa, Homo sapiens
  Native (MAGC1_HUMAN)
GEDSLSSLHFPQSPPE

SEQ ID NO: 248924 - protein, 17 aa, Homo sapiens
  Native (MAGC1_HUMAN)
GEDSLSSLHFPQSPPEW

SEQ ID NO: 248925 - protein, 19 aa, Homo sapiens
  Native (MAGC1_HUMAN)
GEDSLSSLHFPQSPPEWED

SEQ ID NO: 248926 - protein, 20 aa, Homo sapiens
  Native (MAGC1_HUMAN)
GEDSLSSLHFPQSPPEWEDS

SEQ ID NO: 248927 - protein, 21 aa, Homo sapiens
  Native (MAGC1_HUMAN)
GEDSLSSLHFPQSPPEWEDSL

SEQ ID NO: 248928 - protein, 22 aa, Homo sapiens
  Native (MAGC1_HUMAN)
GEDSLSSLHFPQSPPEWEDSLS

SEQ ID NO: 248929 - protein, 23 aa, Homo sapiens
  Native (MAGC1_HUMAN)
GEDSLSSLHFPQSPPEWEDSLSP

SEQ ID NO: 248930 - protein, 24 aa, Homo sapiens
  Native (MAGC1_HUMAN)
GEDSLSSLHFPQSPPEWEDSLSPL

SEQ ID NO: 248931 - protein, 25 aa, Homo sapiens
  Native (MAGC1_HUMAN)
GEDSLSSLHFPQSPPEWEDSLSPLH

SEQ ID NO: 248932 - protein, 15 aa, Homo sapiens
  Native (MAGC1_HUMAN)
GEDSMSPLYFPQSPL

SEQ ID NO: 248933 - protein, 17 aa, Homo sapiens
  Native (MAGC1_HUMAN)
GEDSMSPLYFPQSPLQG

SEQ ID NO: 248934 - protein, 19 aa, Homo sapiens
  Native (MAGC1_HUMAN)
GEDSMSPLYFPQSPLQGEE

SEQ ID NO: 248935 - protein, 20 aa, Homo sapiens
  Native (MAGC1_HUMAN)
GEDSMSPLYFPQSPLQGEEF

SEQ ID NO: 248936 - protein, 21 aa, Homo sapiens
  Native (MAGC1_HUMAN)
GEDSMSPLYFPQSPLQGEEFQ

SEQ ID NO: 248937 - protein, 22 aa, Homo sapiens
  Native (MAGC1_HUMAN)
GEDSMSPLYFPQSPLQGEEFQS

SEQ ID NO: 248938 - protein, 23 aa, Homo sapiens
  Native (MAGC1_HUMAN)
GEDSMSPLYFPQSPLQGEEFQSS

SEQ ID NO: 248939 - protein, 24 aa, Homo sapiens
  Native (MAGC1_HUMAN)
GEDSMSPLYFPQSPLQGEEFQSSL

SEQ ID NO: 248940 - protein, 25 aa, Homo sapiens
  Native (MAGC1_HUMAN)
GEDSMSPLYFPQSPLQGEEFQSSLQ

SEQ ID NO: 248941 - protein, 19 aa, Homo sapiens
  Native (MAGC1_HUMAN)
GEDVQSPLQNPASSFFSSA

SEQ ID NO: 248942 - protein, 20 aa, Homo sapiens
  Native (MAGC1_HUMAN)
GEDVQSPLQNPASSFFSSAL

SEQ ID NO: 248943 - protein, 21 aa, Homo sapiens
  Native (MAGC1_HUMAN)
GEDVQSPLQNPASSFFSSALL

SEQ ID NO: 248944 - protein, 22 aa, Homo sapiens
  Native (MAGC1_HUMAN)
GEDVQSPLQNPASSFFSSALLS

SEQ ID NO: 248945 - protein, 23 aa, Homo sapiens
  Native (MAGC1_HUMAN)
GEDVQSPLQNPASSFFSSALLSI

SEQ ID NO: 248946 - protein, 24 aa, Homo sapiens
  Native (MAGC1_HUMAN)
GEDVQSPLQNPASSFFSSALLSIF

SEQ ID NO: 248947 - protein, 25 aa, Homo sapiens
  Native (MAGC1_HUMAN)
GEDVQSPLQNPASSFFSSALLSIFQ

SEQ ID NO: 248948 - protein, 14 aa, Homo sapiens
  Native (MAGC1_HUMAN)
GEEFQSSLQSPVSI

SEQ ID NO: 248949 - protein, 15 aa, Homo sapiens
  Native (MAGC1_HUMAN)
GEEFQSSLQSPVSIC

SEQ ID NO: 248950 - protein, 16 aa, Homo sapiens
  Native (MAGC1_HUMAN)
GEEFQSSLQSPVSICS

SEQ ID NO: 248951 - protein, 17 aa, Homo sapiens
  Native (MAGC1_HUMAN)
GEEFQSSLQSPVSICSS

SEQ ID NO: 248952 - protein, 19 aa, Homo sapiens
  Native (MAGC1_HUMAN)
GEEFQSSLQSPVSICSSST

SEQ ID NO: 248953 - protein, 20 aa, Homo sapiens
  Native (MAGC1_HUMAN)
GEEFQSSLQSPVSICSSSTP

SEQ ID NO: 248954 - protein, 21 aa, Homo sapiens
  Native (MAGC1_HUMAN)
GEEFQSSLQSPVSICSSSTPS

SEQ ID NO: 248955 - protein, 22 aa, Homo sapiens
  Native (MAGC1_HUMAN)
GEEFQSSLQSPVSICSSSTPSS

SEQ ID NO: 248956 - protein, 23 aa, Homo sapiens
  Native (MAGC1_HUMAN)
GEEFQSSLQSPVSICSSSTPSSL

SEQ ID NO: 248957 - protein, 24 aa, Homo sapiens
  Native (MAGC1_HUMAN)
GEEFQSSLQSPVSICSSSTPSSLP

SEQ ID NO: 248958 - protein, 25 aa, Homo sapiens
  Native (MAGC1_HUMAN)
GEEFQSSLQSPVSICSSSTPSSLPQ

SEQ ID NO: 248959 - protein, 14 aa, Homo sapiens
  Native (MAGC1_HUMAN)
GENTHSPLQIVPSL

SEQ ID NO: 248960 - protein, 15 aa, Homo sapiens
  Native (MAGC1_HUMAN)
GENTHSPLQIVPSLP

SEQ ID NO: 248961 - protein, 16 aa, Homo sapiens
  Native (MAGC1_HUMAN)
GENTHSPLQIVPSLPE

SEQ ID NO: 248962 - protein, 17 aa, Homo sapiens
  Native (MAGC1_HUMAN)
GENTHSPLQIVPSLPEW

SEQ ID NO: 248963 - protein, 18 aa, Homo sapiens
  Native (MAGC1_HUMAN)
GENTHSPLQIVPSLPEWE

SEQ ID NO: 248964 - protein, 19 aa, Homo sapiens
  Native (MAGC1_HUMAN)
GENTHSPLQIVPSLPEWED

SEQ ID NO: 248965 - protein, 20 aa, Homo sapiens
  Native (MAGC1_HUMAN)
GENTHSPLQIVPSLPEWEDS

SEQ ID NO: 248966 - protein, 21 aa, Homo sapiens
  Native (MAGC1_HUMAN)
GENTHSPLQIVPSLPEWEDSL

SEQ ID NO: 248967 - protein, 22 aa, Homo sapiens
  Native (MAGC1_HUMAN)
GENTHSPLQIVPSLPEWEDSLS

SEQ ID NO: 248968 - protein, 23 aa, Homo sapiens
  Native (MAGC1_HUMAN)
GENTHSPLQIVPSLPEWEDSLSP

SEQ ID NO: 248969 - protein, 24 aa, Homo sapiens
  Native (MAGC1_HUMAN)
GENTHSPLQIVPSLPEWEDSLSPH

SEQ ID NO: 248970 - protein, 25 aa, Homo sapiens
  Native (MAGC1_HUMAN)
GENTHSPLQIVPSLPEWEDSLSPHY

SEQ ID NO: 248971 - protein, 14 aa, Homo sapiens
  Native (MAGC1_HUMAN)
GEPRELLTKVWVQE

SEQ ID NO: 248972 - protein, 15 aa, Homo sapiens
  Native (MAGC1_HUMAN)
GEPRELLTKVWVQEH

SEQ ID NO: 248973 - protein, 16 aa, Homo sapiens
  Native (MAGC1_HUMAN)
GEPRELLTKVWVQEHY

SEQ ID NO: 248974 - protein, 17 aa, Homo sapiens
  Native (MAGC1_HUMAN)
GEPRELLTKVWVQEHYL

SEQ ID NO: 248975 - protein, 18 aa, Homo sapiens
  Native (MAGC1_HUMAN)
GEPRELLTKVWVQEHYLE

SEQ ID NO: 248976 - protein, 19 aa, Homo sapiens
  Native (MAGC1_HUMAN)
GEPRELLTKVWVQEHYLEY

SEQ ID NO: 248977 - protein, 20 aa, Homo sapiens
  Native (MAGC1_HUMAN)
GEPRELLTKVWVQEHYLEYR

SEQ ID NO: 248978 - protein, 21 aa, Homo sapiens
  Native (MAGC1_HUMAN)
GEPRELLTKVWVQEHYLEYRE

SEQ ID NO: 248979 - protein, 22 aa, Homo sapiens
  Native (MAGC1_HUMAN)
GEPRELLTKVWVQEHYLEYREV

SEQ ID NO: 248980 - protein, 23 aa, Homo sapiens
  Native (MAGC1_HUMAN)
GEPRELLTKVWVQEHYLEYREVP

SEQ ID NO: 248981 - protein, 24 aa, Homo sapiens
  Native (MAGC1_HUMAN)
GEPRELLTKVWVQEHYLEYREVPN

SEQ ID NO: 248982 - protein, 25 aa, Homo sapiens
  Native (MAGC1_HUMAN)
GEPRELLTKVWVQEHYLEYREVPNS

SEQ ID NO: 248983 - protein, 15 aa, Homo sapiens
  Native (MAGC1_HUMAN)
GFAQSPLQIPVSPSS

SEQ ID NO: 248984 - protein, 16 aa, Homo sapiens
  Native (MAGC1_HUMAN)
GFAQSPLQIPVSPSSS

SEQ ID NO: 248985 - protein, 20 aa, Homo sapiens
  Native (MAGC1_HUMAN)
GFAQSPLQIPVSPSSSSTLL

SEQ ID NO: 248986 - protein, 21 aa, Homo sapiens
  Native (MAGC1_HUMAN)
GFAQSPLQIPVSPSSSSTLLS

SEQ ID NO: 248987 - protein, 22 aa, Homo sapiens
  Native (MAGC1_HUMAN)
GFAQSPLQIPVSPSSSSTLLSL

SEQ ID NO: 248988 - protein, 23 aa, Homo sapiens
  Native (MAGC1_HUMAN)
GFAQSPLQIPVSPSSSSTLLSLF

SEQ ID NO: 248989 - protein, 24 aa, Homo sapiens
  Native (MAGC1_HUMAN)
GFAQSPLQIPVSPSSSSTLLSLFQ

SEQ ID NO: 248990 - protein, 25 aa, Homo sapiens
  Native (MAGC1_HUMAN)
GFAQSPLQIPVSPSSSSTLLSLFQS

SEQ ID NO: 248991 - protein, 14 aa, Homo sapiens
  Native (MAGC1_HUMAN)
GFAQSSLQIPVSPS

SEQ ID NO: 248992 - protein, 15 aa, Homo sapiens
  Native (MAGC1_HUMAN)
GFAQSSLQIPVSPSF

SEQ ID NO: 248993 - protein, 16 aa, Homo sapiens
  Native (MAGC1_HUMAN)
GFAQSSLQIPVSPSFS

SEQ ID NO: 248994 - protein, 17 aa, Homo sapiens
  Native (MAGC1_HUMAN)
GFAQSSLQIPVSPSFSS

SEQ ID NO: 248995 - protein, 19 aa, Homo sapiens
  Native (MAGC1_HUMAN)
GFAQSSLQIPVSPSFSSTL

SEQ ID NO: 248996 - protein, 20 aa, Homo sapiens
  Native (MAGC1_HUMAN)
GFAQSSLQIPVSPSFSSTLV

SEQ ID NO: 248997 - protein, 21 aa, Homo sapiens
  Native (MAGC1_HUMAN)
GFAQSSLQIPVSPSFSSTLVS

SEQ ID NO: 248998 - protein, 22 aa, Homo sapiens
  Native (MAGC1_HUMAN)
GFAQSSLQIPVSPSFSSTLVSL

SEQ ID NO: 248999 - protein, 23 aa, Homo sapiens
  Native (MAGC1_HUMAN)
GFAQSSLQIPVSPSFSSTLVSLF

SEQ ID NO: 249000 - protein, 24 aa, Homo sapiens
  Native (MAGC1_HUMAN)
GFAQSSLQIPVSPSFSSTLVSLFQ

SEQ ID NO: 249001 - protein, 25 aa, Homo sapiens
  Native (MAGC1_HUMAN)
GFAQSSLQIPVSPSFSSTLVSLFQS

SEQ ID NO: 249002 - protein, 14 aa, Homo sapiens
  Native (MAGC1_HUMAN)
GFPQSLLQIPMTSS

SEQ ID NO: 249003 - protein, 15 aa, Homo sapiens
  Native (MAGC1_HUMAN)
GFPQSLLQIPMTSSF

SEQ ID NO: 249004 - protein, 16 aa, Homo sapiens
  Native (MAGC1_HUMAN)
GFPQSLLQIPMTSSFS

SEQ ID NO: 249005 - protein, 17 aa, Homo sapiens
  Native (MAGC1_HUMAN)
GFPQSLLQIPMTSSFSS

SEQ ID NO: 249006 - protein, 18 aa, Homo sapiens
  Native (MAGC1_HUMAN)
GFPQSLLQIPMTSSFSST

SEQ ID NO: 249007 - protein, 19 aa, Homo sapiens
  Native (MAGC1_HUMAN)
GFPQSLLQIPMTSSFSSTL

SEQ ID NO: 249008 - protein, 20 aa, Homo sapiens
  Native (MAGC1_HUMAN)
GFPQSLLQIPMTSSFSSTLL

SEQ ID NO: 249009 - protein, 21 aa, Homo sapiens
  Native (MAGC1_HUMAN)
GFPQSLLQIPMTSSFSSTLLS

SEQ ID NO: 249010 - protein, 22 aa, Homo sapiens
  Native (MAGC1_HUMAN)
GFPQSLLQIPMTSSFSSTLLSI

SEQ ID NO: 249011 - protein, 23 aa, Homo sapiens
  Native (MAGC1_HUMAN)
GFPQSLLQIPMTSSFSSTLLSIF

SEQ ID NO: 249012 - protein, 24 aa, Homo sapiens
  Native (MAGC1_HUMAN)
GFPQSLLQIPMTSSFSSTLLSIFQ

SEQ ID NO: 249013 - protein, 25 aa, Homo sapiens
  Native (MAGC1_HUMAN)
GFPQSLLQIPMTSSFSSTLLSIFQS

SEQ ID NO: 249014 - protein, 16 aa, Homo sapiens
  Native (MAGC1_HUMAN)
GFPQSPLQIPGSPSFS

SEQ ID NO: 249015 - protein, 17 aa, Homo sapiens
  Native (MAGC1_HUMAN)
GFPQSPLQIPGSPSFSS

SEQ ID NO: 249016 - protein, 19 aa, Homo sapiens
  Native (MAGC1_HUMAN)
GFPQSPLQIPGSPSFSSTL

SEQ ID NO: 249017 - protein, 20 aa, Homo sapiens
  Native (MAGC1_HUMAN)
GFPQSPLQIPGSPSFSSTLL

SEQ ID NO: 249018 - protein, 21 aa, Homo sapiens
  Native (MAGC1_HUMAN)
GFPQSPLQIPGSPSFSSTLLS

SEQ ID NO: 249019 - protein, 22 aa, Homo sapiens
  Native (MAGC1_HUMAN)
GFPQSPLQIPGSPSFSSTLLSL

SEQ ID NO: 249020 - protein, 23 aa, Homo sapiens
  Native (MAGC1_HUMAN)
GFPQSPLQIPGSPSFSSTLLSLF

SEQ ID NO: 249021 - protein, 24 aa, Homo sapiens
  Native (MAGC1_HUMAN)
GFPQSPLQIPGSPSFSSTLLSLFQ

SEQ ID NO: 249022 - protein, 25 aa, Homo sapiens
  Native (MAGC1_HUMAN)
GFPQSPLQIPGSPSFSSTLLSLFQS

SEQ ID NO: 249023 - protein, 15 aa, Homo sapiens
  Native (MAGC1_HUMAN)
GFPQSPLQIPMTSSF

SEQ ID NO: 249024 - protein, 17 aa, Homo sapiens
  Native (MAGC1_HUMAN)
GFPQSPLQIPMTSSFSS

SEQ ID NO: 249025 - protein, 19 aa, Homo sapiens
  Native (MAGC1_HUMAN)
GFPQSPLQIPMTSSFSSTL

SEQ ID NO: 249026 - protein, 20 aa, Homo sapiens
  Native (MAGC1_HUMAN)
GFPQSPLQIPMTSSFSSTLL

SEQ ID NO: 249027 - protein, 21 aa, Homo sapiens
  Native (MAGC1_HUMAN)
GFPQSPLQIPMTSSFSSTLLS

SEQ ID NO: 249028 - protein, 22 aa, Homo sapiens
  Native (MAGC1_HUMAN)
GFPQSPLQIPMTSSFSSTLLSI

SEQ ID NO: 249029 - protein, 23 aa, Homo sapiens
  Native (MAGC1_HUMAN)
GFPQSPLQIPMTSSFSSTLLSIL

SEQ ID NO: 249030 - protein, 24 aa, Homo sapiens
  Native (MAGC1_HUMAN)
GFPQSPLQIPMTSSFSSTLLSILQ

SEQ ID NO: 249031 - protein, 25 aa, Homo sapiens
  Native (MAGC1_HUMAN)
GFPQSPLQIPMTSSFSSTLLSILQS

SEQ ID NO: 249032 - protein, 15 aa, Homo sapiens
  Native (MAGC1_HUMAN)
GFPQSPLQIPVSRSF

SEQ ID NO: 249033 - protein, 19 aa, Homo sapiens
  Native (MAGC1_HUMAN)
GFPQSPLQIPVSRSFSSTL

SEQ ID NO: 249034 - protein, 20 aa, Homo sapiens
  Native (MAGC1_HUMAN)
GFPQSPLQIPVSRSFSSTLL

SEQ ID NO: 249035 - protein, 21 aa, Homo sapiens
  Native (MAGC1_HUMAN)
GFPQSPLQIPVSRSFSSTLLS

SEQ ID NO: 249036 - protein, 22 aa, Homo sapiens
  Native (MAGC1_HUMAN)
GFPQSPLQIPVSRSFSSTLLSI

SEQ ID NO: 249037 - protein, 23 aa, Homo sapiens
  Native (MAGC1_HUMAN)
GFPQSPLQIPVSRSFSSTLLSIF

SEQ ID NO: 249038 - protein, 24 aa, Homo sapiens
  Native (MAGC1_HUMAN)
GFPQSPLQIPVSRSFSSTLLSIFQ

SEQ ID NO: 249039 - protein, 25 aa, Homo sapiens
  Native (MAGC1_HUMAN)
GFPQSPLQIPVSRSFSSTLLSIFQS

SEQ ID NO: 249040 - protein, 19 aa, Homo sapiens
  Native (MAGC1_HUMAN)
GFPQSPLQIPVSSSFSYTL

SEQ ID NO: 249041 - protein, 20 aa, Homo sapiens
  Native (MAGC1_HUMAN)
GFPQSPLQIPVSSSFSYTLL

SEQ ID NO: 249042 - protein, 21 aa, Homo sapiens
  Native (MAGC1_HUMAN)
GFPQSPLQIPVSSSFSYTLLS

SEQ ID NO: 249043 - protein, 22 aa, Homo sapiens
  Native (MAGC1_HUMAN)
GFPQSPLQIPVSSSFSYTLLSL

SEQ ID NO: 249044 - protein, 23 aa, Homo sapiens
  Native (MAGC1_HUMAN)
GFPQSPLQIPVSSSFSYTLLSLF

SEQ ID NO: 249045 - protein, 24 aa, Homo sapiens
  Native (MAGC1_HUMAN)
GFPQSPLQIPVSSSFSYTLLSLFQ

SEQ ID NO: 249046 - protein, 25 aa, Homo sapiens
  Native (MAGC1_HUMAN)
GFPQSPLQIPVSSSFSYTLLSLFQS

SEQ ID NO: 249047 - protein, 19 aa, Homo sapiens
  Native (MAGC1_HUMAN)
GFPQSPLQIPVSSSSSSST

SEQ ID NO: 249048 - protein, 20 aa, Homo sapiens
  Native (MAGC1_HUMAN)
GFPQSPLQIPVSSSSSSSTL

SEQ ID NO: 249049 - protein, 21 aa, Homo sapiens
  Native (MAGC1_HUMAN)
GFPQSPLQIPVSSSSSSSTLL

SEQ ID NO: 249050 - protein, 22 aa, Homo sapiens
  Native (MAGC1_HUMAN)
GFPQSPLQIPVSSSSSSSTLLS

SEQ ID NO: 249051 - protein, 23 aa, Homo sapiens
  Native (MAGC1_HUMAN)
GFPQSPLQIPVSSSSSSSTLLSL

SEQ ID NO: 249052 - protein, 24 aa, Homo sapiens
  Native (MAGC1_HUMAN)
GFPQSPLQIPVSSSSSSSTLLSLF

SEQ ID NO: 249053 - protein, 25 aa, Homo sapiens
  Native (MAGC1_HUMAN)
GFPQSPLQIPVSSSSSSSTLLSLFQ

SEQ ID NO: 249054 - protein, 19 aa, Homo sapiens
  Native (MAGC1_HUMAN)
GFPQSPLQIPVSSSSSSTL

SEQ ID NO: 249055 - protein, 20 aa, Homo sapiens
  Native (MAGC1_HUMAN)
GFPQSPLQIPVSSSSSSTLL

SEQ ID NO: 249056 - protein, 21 aa, Homo sapiens
  Native (MAGC1_HUMAN)
GFPQSPLQIPVSSSSSSTLLS

SEQ ID NO: 249057 - protein, 22 aa, Homo sapiens
  Native (MAGC1_HUMAN)
GFPQSPLQIPVSSSSSSTLLSL

SEQ ID NO: 249058 - protein, 23 aa, Homo sapiens
  Native (MAGC1_HUMAN)
GFPQSPLQIPVSSSSSSTLLSLF

SEQ ID NO: 249059 - protein, 24 aa, Homo sapiens
  Native (MAGC1_HUMAN)
GFPQSPLQIPVSSSSSSTLLSLFQ

SEQ ID NO: 249060 - protein, 25 aa, Homo sapiens
  Native (MAGC1_HUMAN)
GFPQSPLQIPVSSSSSSTLLSLFQS

SEQ ID NO: 249061 - protein, 14 aa, Homo sapiens
  Native (MAGC1_HUMAN)
GFPQSVLQIPVSAA

SEQ ID NO: 249062 - protein, 15 aa, Homo sapiens
  Native (MAGC1_HUMAN)
GFPQSVLQIPVSAAS

SEQ ID NO: 249063 - protein, 16 aa, Homo sapiens
  Native (MAGC1_HUMAN)
GFPQSVLQIPVSAASS

SEQ ID NO: 249064 - protein, 17 aa, Homo sapiens
  Native (MAGC1_HUMAN)
GFPQSVLQIPVSAASSS

SEQ ID NO: 249065 - protein, 18 aa, Homo sapiens
  Native (MAGC1_HUMAN)
GFPQSVLQIPVSAASSST

SEQ ID NO: 249066 - protein, 19 aa, Homo sapiens
  Native (MAGC1_HUMAN)
GFPQSVLQIPVSAASSSTL

SEQ ID NO: 249067 - protein, 20 aa, Homo sapiens
  Native (MAGC1_HUMAN)
GFPQSVLQIPVSAASSSTLV

SEQ ID NO: 249068 - protein, 21 aa, Homo sapiens
  Native (MAGC1_HUMAN)
GFPQSVLQIPVSAASSSTLVS

SEQ ID NO: 249069 - protein, 22 aa, Homo sapiens
  Native (MAGC1_HUMAN)
GFPQSVLQIPVSAASSSTLVSI

SEQ ID NO: 249070 - protein, 23 aa, Homo sapiens
  Native (MAGC1_HUMAN)
GFPQSVLQIPVSAASSSTLVSIF

SEQ ID NO: 249071 - protein, 24 aa, Homo sapiens
  Native (MAGC1_HUMAN)
GFPQSVLQIPVSAASSSTLVSIFQ

SEQ ID NO: 249072 - protein, 25 aa, Homo sapiens
  Native (MAGC1_HUMAN)
GFPQSVLQIPVSAASSSTLVSIFQS

SEQ ID NO: 249073 - protein, 14 aa, Homo sapiens
  Native (MAGC1_HUMAN)
GIGVRAGREHFAFG

SEQ ID NO: 249074 - protein, 15 aa, Homo sapiens
  Native (MAGC1_HUMAN)
GIGVRAGREHFAFGE

SEQ ID NO: 249075 - protein, 16 aa, Homo sapiens
  Native (MAGC1_HUMAN)
GIGVRAGREHFAFGEP

SEQ ID NO: 249076 - protein, 17 aa, Homo sapiens
  Native (MAGC1_HUMAN)
GIGVRAGREHFAFGEPR

SEQ ID NO: 249077 - protein, 19 aa, Homo sapiens
  Native (MAGC1_HUMAN)
GIGVRAGREHFAFGEPREL

SEQ ID NO: 249078 - protein, 20 aa, Homo sapiens
  Native (MAGC1_HUMAN)
GIGVRAGREHFAFGEPRELL

SEQ ID NO: 249079 - protein, 21 aa, Homo sapiens
  Native (MAGC1_HUMAN)
GIGVRAGREHFAFGEPRELLT

SEQ ID NO: 249080 - protein, 22 aa, Homo sapiens
  Native (MAGC1_HUMAN)
GIGVRAGREHFAFGEPRELLTK

SEQ ID NO: 249081 - protein, 23 aa, Homo sapiens
  Native (MAGC1_HUMAN)
GIGVRAGREHFAFGEPRELLTKV

SEQ ID NO: 249082 - protein, 24 aa, Homo sapiens
  Native (MAGC1_HUMAN)
GIGVRAGREHFAFGEPRELLTKVW

SEQ ID NO: 249083 - protein, 25 aa, Homo sapiens
  Native (MAGC1_HUMAN)
GIGVRAGREHFAFGEPRELLTKVWV

SEQ ID NO: 249084 - protein, 20 aa, Homo sapiens
  Native (MAGC1_HUMAN)
GISLREVDPDDSYVFVNTLD

SEQ ID NO: 249085 - protein, 21 aa, Homo sapiens
  Native (MAGC1_HUMAN)
GISLREVDPDDSYVFVNTLDL

SEQ ID NO: 249086 - protein, 22 aa, Homo sapiens
  Native (MAGC1_HUMAN)
GISLREVDPDDSYVFVNTLDLT

SEQ ID NO: 249087 - protein, 23 aa, Homo sapiens
  Native (MAGC1_HUMAN)
GISLREVDPDDSYVFVNTLDLTS

SEQ ID NO: 249088 - protein, 24 aa, Homo sapiens
  Native (MAGC1_HUMAN)
GISLREVDPDDSYVFVNTLDLTSE

SEQ ID NO: 249089 - protein, 25 aa, Homo sapiens
  Native (MAGC1_HUMAN)
GISLREVDPDDSYVFVNTLDLTSEG

SEQ ID NO: 249090 - protein, 15 aa, Homo sapiens
  Native (MAGC1_HUMAN)
GKDSLSPLEISQSPP

SEQ ID NO: 249091 - protein, 20 aa, Homo sapiens
  Native (MAGC1_HUMAN)
GKDSLSPLEISQSPPEGEDV

SEQ ID NO: 249092 - protein, 13 aa, Homo sapiens
  Native (MAGC1_HUMAN)
GMSQNRLLILILS

SEQ ID NO: 249093 - protein, 14 aa, Homo sapiens
  Native (MAGC1_HUMAN)
GMSQNRLLILILSI

SEQ ID NO: 249094 - protein, 15 aa, Homo sapiens
  Native (MAGC1_HUMAN)
GMSQNRLLILILSII

SEQ ID NO: 249095 - protein, 16 aa, Homo sapiens
  Native (MAGC1_HUMAN)
GMSQNRLLILILSIIF

SEQ ID NO: 249096 - protein, 17 aa, Homo sapiens
  Native (MAGC1_HUMAN)
GMSQNRLLILILSIIFI

SEQ ID NO: 249097 - protein, 18 aa, Homo sapiens
  Native (MAGC1_HUMAN)
GMSQNRLLILILSIIFIK

SEQ ID NO: 249098 - protein, 19 aa, Homo sapiens
  Native (MAGC1_HUMAN)
GMSQNRLLILILSIIFIKG

SEQ ID NO: 249099 - protein, 20 aa, Homo sapiens
  Native (MAGC1_HUMAN)
GMSQNRLLILILSIIFIKGT

SEQ ID NO: 249100 - protein, 21 aa, Homo sapiens
  Native (MAGC1_HUMAN)
GMSQNRLLILILSIIFIKGTY

SEQ ID NO: 249101 - protein, 22 aa, Homo sapiens
  Native (MAGC1_HUMAN)
GMSQNRLLILILSIIFIKGTYA

SEQ ID NO: 249102 - protein, 23 aa, Homo sapiens
  Native (MAGC1_HUMAN)
GMSQNRLLILILSIIFIKGTYAS

SEQ ID NO: 249103 - protein, 24 aa, Homo sapiens
  Native (MAGC1_HUMAN)
GMSQNRLLILILSIIFIKGTYASE

SEQ ID NO: 249104 - protein, 25 aa, Homo sapiens
  Native (MAGC1_HUMAN)
GMSQNRLLILILSIIFIKGTYASEE

SEQ ID NO: 249105 - protein, 17 aa, Homo sapiens
  Native (MAGC1_HUMAN)
GPAQSPLQRPVSSFFSY

SEQ ID NO: 249106 - protein, 19 aa, Homo sapiens
  Native (MAGC1_HUMAN)
GPAQSPLQRPVSSFFSYTL

SEQ ID NO: 249107 - protein, 20 aa, Homo sapiens
  Native (MAGC1_HUMAN)
GPAQSPLQRPVSSFFSYTLA

SEQ ID NO: 249108 - protein, 21 aa, Homo sapiens
  Native (MAGC1_HUMAN)
GPAQSPLQRPVSSFFSYTLAS

SEQ ID NO: 249109 - protein, 22 aa, Homo sapiens
  Native (MAGC1_HUMAN)
GPAQSPLQRPVSSFFSYTLASL

SEQ ID NO: 249110 - protein, 23 aa, Homo sapiens
  Native (MAGC1_HUMAN)
GPAQSPLQRPVSSFFSYTLASLL

SEQ ID NO: 249111 - protein, 24 aa, Homo sapiens
  Native (MAGC1_HUMAN)
GPAQSPLQRPVSSFFSYTLASLLQ

SEQ ID NO: 249112 - protein, 25 aa, Homo sapiens
  Native (MAGC1_HUMAN)
GPAQSPLQRPVSSFFSYTLASLLQS

SEQ ID NO: 249113 - protein, 19 aa, Homo sapiens
  Native (MAGC1_HUMAN)
GPAQSPLQSPVSSFPSSTS

SEQ ID NO: 249114 - protein, 20 aa, Homo sapiens
  Native (MAGC1_HUMAN)
GPAQSPLQSPVSSFPSSTSS

SEQ ID NO: 249115 - protein, 21 aa, Homo sapiens
  Native (MAGC1_HUMAN)
GPAQSPLQSPVSSFPSSTSSS

SEQ ID NO: 249116 - protein, 22 aa, Homo sapiens
  Native (MAGC1_HUMAN)
GPAQSPLQSPVSSFPSSTSSSL

SEQ ID NO: 249117 - protein, 23 aa, Homo sapiens
  Native (MAGC1_HUMAN)
GPAQSPLQSPVSSFPSSTSSSLS

SEQ ID NO: 249118 - protein, 24 aa, Homo sapiens
  Native (MAGC1_HUMAN)
GPAQSPLQSPVSSFPSSTSSSLSQ

SEQ ID NO: 249119 - protein, 25 aa, Homo sapiens
  Native (MAGC1_HUMAN)
GPAQSPLQSPVSSFPSSTSSSLSQS

SEQ ID NO: 249120 - protein, 15 aa, Homo sapiens
  Native (MAGC1_HUMAN)
GPRAHSEVIKRKVVE

SEQ ID NO: 249121 - protein, 16 aa, Homo sapiens
  Native (MAGC1_HUMAN)
GPRAHSEVIKRKVVEF

SEQ ID NO: 249122 - protein, 17 aa, Homo sapiens
  Native (MAGC1_HUMAN)
GPRAHSEVIKRKVVEFL

SEQ ID NO: 249123 - protein, 19 aa, Homo sapiens
  Native (MAGC1_HUMAN)
GPRAHSEVIKRKVVEFLAM

SEQ ID NO: 249124 - protein, 20 aa, Homo sapiens
  Native (MAGC1_HUMAN)
GPRAHSEVIKRKVVEFLAML

SEQ ID NO: 249125 - protein, 21 aa, Homo sapiens
  Native (MAGC1_HUMAN)
GPRAHSEVIKRKVVEFLAMLK

SEQ ID NO: 249126 - protein, 22 aa, Homo sapiens
  Native (MAGC1_HUMAN)
GPRAHSEVIKRKVVEFLAMLKN

SEQ ID NO: 249127 - protein, 23 aa, Homo sapiens
  Native (MAGC1_HUMAN)
GPRAHSEVIKRKVVEFLAMLKNT

SEQ ID NO: 249128 - protein, 24 aa, Homo sapiens
  Native (MAGC1_HUMAN)
GPRAHSEVIKRKVVEFLAMLKNTV

SEQ ID NO: 249129 - protein, 25 aa, Homo sapiens
  Native (MAGC1_HUMAN)
GPRAHSEVIKRKVVEFLAMLKNTVP

SEQ ID NO: 249130 - protein, 14 aa, Homo sapiens
  Native (MAGC1_HUMAN)
GREHFAFGEPRELL

SEQ ID NO: 249131 - protein, 15 aa, Homo sapiens
  Native (MAGC1_HUMAN)
GREHFAFGEPRELLT

SEQ ID NO: 249132 - protein, 16 aa, Homo sapiens
  Native (MAGC1_HUMAN)
GREHFAFGEPRELLTK

SEQ ID NO: 249133 - protein, 17 aa, Homo sapiens
  Native (MAGC1_HUMAN)
GREHFAFGEPRELLTKV

SEQ ID NO: 249134 - protein, 18 aa, Homo sapiens
  Native (MAGC1_HUMAN)
GREHFAFGEPRELLTKVW

SEQ ID NO: 249135 - protein, 19 aa, Homo sapiens
  Native (MAGC1_HUMAN)
GREHFAFGEPRELLTKVWV

SEQ ID NO: 249136 - protein, 20 aa, Homo sapiens
  Native (MAGC1_HUMAN)
GREHFAFGEPRELLTKVWVQ

SEQ ID NO: 249137 - protein, 21 aa, Homo sapiens
  Native (MAGC1_HUMAN)
GREHFAFGEPRELLTKVWVQE

SEQ ID NO: 249138 - protein, 22 aa, Homo sapiens
  Native (MAGC1_HUMAN)
GREHFAFGEPRELLTKVWVQEH

SEQ ID NO: 249139 - protein, 23 aa, Homo sapiens
  Native (MAGC1_HUMAN)
GREHFAFGEPRELLTKVWVQEHY

SEQ ID NO: 249140 - protein, 24 aa, Homo sapiens
  Native (MAGC1_HUMAN)
GREHFAFGEPRELLTKVWVQEHYL

SEQ ID NO: 249141 - protein, 25 aa, Homo sapiens
  Native (MAGC1_HUMAN)
GREHFAFGEPRELLTKVWVQEHYLE

SEQ ID NO: 249142 - protein, 13 aa, Homo sapiens
  Native (MAGC1_HUMAN)
GSPSFSSTLLSLF

SEQ ID NO: 249143 - protein, 14 aa, Homo sapiens
  Native (MAGC1_HUMAN)
GSPSFSSTLLSLFQ

SEQ ID NO: 249144 - protein, 15 aa, Homo sapiens
  Native (MAGC1_HUMAN)
GSPSFSSTLLSLFQS

SEQ ID NO: 249145 - protein, 16 aa, Homo sapiens
  Native (MAGC1_HUMAN)
GSPSFSSTLLSLFQSS

SEQ ID NO: 249146 - protein, 17 aa, Homo sapiens
  Native (MAGC1_HUMAN)
GSPSFSSTLLSLFQSSP

SEQ ID NO: 249147 - protein, 18 aa, Homo sapiens
  Native (MAGC1_HUMAN)
GSPSFSSTLLSLFQSSPE

SEQ ID NO: 249148 - protein, 19 aa, Homo sapiens
  Native (MAGC1_HUMAN)
GSPSFSSTLLSLFQSSPER

SEQ ID NO: 249149 - protein, 20 aa, Homo sapiens
  Native (MAGC1_HUMAN)
GSPSFSSTLLSLFQSSPERT

SEQ ID NO: 249150 - protein, 21 aa, Homo sapiens
  Native (MAGC1_HUMAN)
GSPSFSSTLLSLFQSSPERTH

SEQ ID NO: 249151 - protein, 22 aa, Homo sapiens
  Native (MAGC1_HUMAN)
GSPSFSSTLLSLFQSSPERTHS

SEQ ID NO: 249152 - protein, 23 aa, Homo sapiens
  Native (MAGC1_HUMAN)
GSPSFSSTLLSLFQSSPERTHST

SEQ ID NO: 249153 - protein, 24 aa, Homo sapiens
  Native (MAGC1_HUMAN)
GSPSFSSTLLSLFQSSPERTHSTF

SEQ ID NO: 249154 - protein, 25 aa, Homo sapiens
  Native (MAGC1_HUMAN)
GSPSFSSTLLSLFQSSPERTHSTFE

SEQ ID NO: 249155 - protein, 14 aa, Homo sapiens
  Native (MAGC1_HUMAN)
GTYASEEVIWDVLS

SEQ ID NO: 249156 - protein, 15 aa, Homo sapiens
  Native (MAGC1_HUMAN)
GTYASEEVIWDVLSG

SEQ ID NO: 249157 - protein, 16 aa, Homo sapiens
  Native (MAGC1_HUMAN)
GTYASEEVIWDVLSGI

SEQ ID NO: 249158 - protein, 17 aa, Homo sapiens
  Native (MAGC1_HUMAN)
GTYASEEVIWDVLSGIG

SEQ ID NO: 249159 - protein, 18 aa, Homo sapiens
  Native (MAGC1_HUMAN)
GTYASEEVIWDVLSGIGV

SEQ ID NO: 249160 - protein, 19 aa, Homo sapiens
  Native (MAGC1_HUMAN)
GTYASEEVIWDVLSGIGVR

SEQ ID NO: 249161 - protein, 20 aa, Homo sapiens
  Native (MAGC1_HUMAN)
GTYASEEVIWDVLSGIGVRA

SEQ ID NO: 249162 - protein, 21 aa, Homo sapiens
  Native (MAGC1_HUMAN)
GTYASEEVIWDVLSGIGVRAG

SEQ ID NO: 249163 - protein, 22 aa, Homo sapiens
  Native (MAGC1_HUMAN)
GTYASEEVIWDVLSGIGVRAGR

SEQ ID NO: 249164 - protein, 23 aa, Homo sapiens
  Native (MAGC1_HUMAN)
GTYASEEVIWDVLSGIGVRAGRE

SEQ ID NO: 249165 - protein, 24 aa, Homo sapiens
  Native (MAGC1_HUMAN)
GTYASEEVIWDVLSGIGVRAGREH

SEQ ID NO: 249166 - protein, 25 aa, Homo sapiens
  Native (MAGC1_HUMAN)
GTYASEEVIWDVLSGIGVRAGREHF

SEQ ID NO: 249167 - protein, 15 aa, Homo sapiens
  Native (MAGC1_HUMAN)
GVRAGREHFAFGEPR

SEQ ID NO: 249168 - protein, 17 aa, Homo sapiens
  Native (MAGC1_HUMAN)
GVRAGREHFAFGEPREL

SEQ ID NO: 249169 - protein, 18 aa, Homo sapiens
  Native (MAGC1_HUMAN)
GVRAGREHFAFGEPRELL

SEQ ID NO: 249170 - protein, 19 aa, Homo sapiens
  Native (MAGC1_HUMAN)
GVRAGREHFAFGEPRELLT

SEQ ID NO: 249171 - protein, 20 aa, Homo sapiens
  Native (MAGC1_HUMAN)
GVRAGREHFAFGEPRELLTK

SEQ ID NO: 249172 - protein, 21 aa, Homo sapiens
  Native (MAGC1_HUMAN)
GVRAGREHFAFGEPRELLTKV

SEQ ID NO: 249173 - protein, 22 aa, Homo sapiens
  Native (MAGC1_HUMAN)
GVRAGREHFAFGEPRELLTKVW

SEQ ID NO: 249174 - protein, 23 aa, Homo sapiens
  Native (MAGC1_HUMAN)
GVRAGREHFAFGEPRELLTKVWV

SEQ ID NO: 249175 - protein, 24 aa, Homo sapiens
  Native (MAGC1_HUMAN)
GVRAGREHFAFGEPRELLTKVWVQ

SEQ ID NO: 249176 - protein, 25 aa, Homo sapiens
  Native (MAGC1_HUMAN)
GVRAGREHFAFGEPRELLTKVWVQE

SEQ ID NO: 249177 - protein, 13 aa, Homo sapiens
  Native (MAGC1_HUMAN)
GYFPVIFRKAREF

SEQ ID NO: 249178 - protein, 14 aa, Homo sapiens
  Native (MAGC1_HUMAN)
GYFPVIFRKAREFI

SEQ ID NO: 249179 - protein, 15 aa, Homo sapiens
  Native (MAGC1_HUMAN)
GYFPVIFRKAREFIE

SEQ ID NO: 249180 - protein, 16 aa, Homo sapiens
  Native (MAGC1_HUMAN)
GYFPVIFRKAREFIEI

SEQ ID NO: 249181 - protein, 17 aa, Homo sapiens
  Native (MAGC1_HUMAN)
GYFPVIFRKAREFIEIL

SEQ ID NO: 249182 - protein, 18 aa, Homo sapiens
  Native (MAGC1_HUMAN)
GYFPVIFRKAREFIEILF

SEQ ID NO: 249183 - protein, 19 aa, Homo sapiens
  Native (MAGC1_HUMAN)
GYFPVIFRKAREFIEILFG

SEQ ID NO: 249184 - protein, 20 aa, Homo sapiens
  Native (MAGC1_HUMAN)
GYFPVIFRKAREFIEILFGI

SEQ ID NO: 249185 - protein, 21 aa, Homo sapiens
  Native (MAGC1_HUMAN)
GYFPVIFRKAREFIEILFGIS

SEQ ID NO: 249186 - protein, 22 aa, Homo sapiens
  Native (MAGC1_HUMAN)
GYFPVIFRKAREFIEILFGISL

SEQ ID NO: 249187 - protein, 23 aa, Homo sapiens
  Native (MAGC1_HUMAN)
GYFPVIFRKAREFIEILFGISLR

SEQ ID NO: 249188 - protein, 24 aa, Homo sapiens
  Native (MAGC1_HUMAN)
GYFPVIFRKAREFIEILFGISLRE

SEQ ID NO: 249189 - protein, 25 aa, Homo sapiens
  Native (MAGC1_HUMAN)
GYFPVIFRKAREFIEILFGISLREV

SEQ ID NO: 249190 - protein, 14 aa, Homo sapiens
  Native (MAGC1_HUMAN)
HFAFGEPRELLTKV

SEQ ID NO: 249191 - protein, 15 aa, Homo sapiens
  Native (MAGC1_HUMAN)
HFAFGEPRELLTKVW

SEQ ID NO: 249192 - protein, 16 aa, Homo sapiens
  Native (MAGC1_HUMAN)
HFAFGEPRELLTKVWV

SEQ ID NO: 249193 - protein, 17 aa, Homo sapiens
  Native (MAGC1_HUMAN)
HFAFGEPRELLTKVWVQ

SEQ ID NO: 249194 - protein, 18 aa, Homo sapiens
  Native (MAGC1_HUMAN)
HFAFGEPRELLTKVWVQE

SEQ ID NO: 249195 - protein, 19 aa, Homo sapiens
  Native (MAGC1_HUMAN)
HFAFGEPRELLTKVWVQEH

SEQ ID NO: 249196 - protein, 20 aa, Homo sapiens
  Native (MAGC1_HUMAN)
HFAFGEPRELLTKVWVQEHY

SEQ ID NO: 249197 - protein, 21 aa, Homo sapiens
  Native (MAGC1_HUMAN)
HFAFGEPRELLTKVWVQEHYL

SEQ ID NO: 249198 - protein, 22 aa, Homo sapiens
  Native (MAGC1_HUMAN)
HFAFGEPRELLTKVWVQEHYLE

SEQ ID NO: 249199 - protein, 23 aa, Homo sapiens
  Native (MAGC1_HUMAN)
HFAFGEPRELLTKVWVQEHYLEY

SEQ ID NO: 249200 - protein, 24 aa, Homo sapiens
  Native (MAGC1_HUMAN)
HFAFGEPRELLTKVWVQEHYLEYR

SEQ ID NO: 249201 - protein, 25 aa, Homo sapiens
  Native (MAGC1_HUMAN)
HFAFGEPRELLTKVWVQEHYLEYRE

SEQ ID NO: 249202 - protein, 20 aa, Homo sapiens
  Native (MAGC1_HUMAN)
HFPQFPPQGEDFQSSLQSPV

SEQ ID NO: 249203 - protein, 21 aa, Homo sapiens
  Native (MAGC1_HUMAN)
HFPQFPPQGEDFQSSLQSPVS

SEQ ID NO: 249204 - protein, 22 aa, Homo sapiens
  Native (MAGC1_HUMAN)
HFPQFPPQGEDFQSSLQSPVSI

SEQ ID NO: 249205 - protein, 23 aa, Homo sapiens
  Native (MAGC1_HUMAN)
HFPQFPPQGEDFQSSLQSPVSIC

SEQ ID NO: 249206 - protein, 24 aa, Homo sapiens
  Native (MAGC1_HUMAN)
HFPQFPPQGEDFQSSLQSPVSICS

SEQ ID NO: 249207 - protein, 25 aa, Homo sapiens
  Native (MAGC1_HUMAN)
HFPQFPPQGEDFQSSLQSPVSICSS

SEQ ID NO: 249208 - protein, 23 aa, Homo sapiens
  Native (MAGC1_HUMAN)
HFPQSPPEWEDSLSPLHFPQFPP

SEQ ID NO: 249209 - protein, 24 aa, Homo sapiens
  Native (MAGC1_HUMAN)
HFPQSPPEWEDSLSPLHFPQFPPQ

SEQ ID NO: 249210 - protein, 25 aa, Homo sapiens
  Native (MAGC1_HUMAN)
HFPQSPPEWEDSLSPLHFPQFPPQG

SEQ ID NO: 249211 - protein, 15 aa, Homo sapiens
  Native (MAGC1_HUMAN)
HSEVIKRKVVEFLAM

SEQ ID NO: 249212 - protein, 16 aa, Homo sapiens
  Native (MAGC1_HUMAN)
HSEVIKRKVVEFLAML

SEQ ID NO: 249213 - protein, 17 aa, Homo sapiens
  Native (MAGC1_HUMAN)
HSEVIKRKVVEFLAMLK

SEQ ID NO: 249214 - protein, 18 aa, Homo sapiens
  Native (MAGC1_HUMAN)
HSEVIKRKVVEFLAMLKN

SEQ ID NO: 249215 - protein, 19 aa, Homo sapiens
  Native (MAGC1_HUMAN)
HSEVIKRKVVEFLAMLKNT

SEQ ID NO: 249216 - protein, 20 aa, Homo sapiens
  Native (MAGC1_HUMAN)
HSEVIKRKVVEFLAMLKNTV

SEQ ID NO: 249217 - protein, 21 aa, Homo sapiens
  Native (MAGC1_HUMAN)
HSEVIKRKVVEFLAMLKNTVP

SEQ ID NO: 249218 - protein, 22 aa, Homo sapiens
  Native (MAGC1_HUMAN)
HSEVIKRKVVEFLAMLKNTVPI

SEQ ID NO: 249219 - protein, 23 aa, Homo sapiens
  Native (MAGC1_HUMAN)
HSEVIKRKVVEFLAMLKNTVPIT

SEQ ID NO: 249220 - protein, 24 aa, Homo sapiens
  Native (MAGC1_HUMAN)
HSEVIKRKVVEFLAMLKNTVPITF

SEQ ID NO: 249221 - protein, 25 aa, Homo sapiens
  Native (MAGC1_HUMAN)
HSEVIKRKVVEFLAMLKNTVPITFP

SEQ ID NO: 249222 - protein, 13 aa, Homo sapiens
  Native (MAGC1_HUMAN)
HSPLQIVPSLPEW

SEQ ID NO: 249223 - protein, 14 aa, Homo sapiens
  Native (MAGC1_HUMAN)
HSPLQIVPSLPEWE

SEQ ID NO: 249224 - protein, 15 aa, Homo sapiens
  Native (MAGC1_HUMAN)
HSPLQIVPSLPEWED

SEQ ID NO: 249225 - protein, 16 aa, Homo sapiens
  Native (MAGC1_HUMAN)
HSPLQIVPSLPEWEDS

SEQ ID NO: 249226 - protein, 17 aa, Homo sapiens
  Native (MAGC1_HUMAN)
HSPLQIVPSLPEWEDSL

SEQ ID NO: 249227 - protein, 18 aa, Homo sapiens
  Native (MAGC1_HUMAN)
HSPLQIVPSLPEWEDSLS

SEQ ID NO: 249228 - protein, 19 aa, Homo sapiens
  Native (MAGC1_HUMAN)
HSPLQIVPSLPEWEDSLSP

SEQ ID NO: 249229 - protein, 20 aa, Homo sapiens
  Native (MAGC1_HUMAN)
HSPLQIVPSLPEWEDSLSPH

SEQ ID NO: 249230 - protein, 21 aa, Homo sapiens
  Native (MAGC1_HUMAN)
HSPLQIVPSLPEWEDSLSPHY

SEQ ID NO: 249231 - protein, 22 aa, Homo sapiens
  Native (MAGC1_HUMAN)
HSPLQIVPSLPEWEDSLSPHYF

SEQ ID NO: 249232 - protein, 23 aa, Homo sapiens
  Native (MAGC1_HUMAN)
HSPLQIVPSLPEWEDSLSPHYFP

SEQ ID NO: 249233 - protein, 24 aa, Homo sapiens
  Native (MAGC1_HUMAN)
HSPLQIVPSLPEWEDSLSPHYFPQ

SEQ ID NO: 249234 - protein, 25 aa, Homo sapiens
  Native (MAGC1_HUMAN)
HSPLQIVPSLPEWEDSLSPHYFPQS

SEQ ID NO: 249235 - protein, 14 aa, Homo sapiens
  Native (MAGC1_HUMAN)
HSTFEGFPQSLLQI

SEQ ID NO: 249236 - protein, 15 aa, Homo sapiens
  Native (MAGC1_HUMAN)
HSTFEGFPQSLLQIP

SEQ ID NO: 249237 - protein, 16 aa, Homo sapiens
  Native (MAGC1_HUMAN)
HSTFEGFPQSLLQIPM

SEQ ID NO: 249238 - protein, 17 aa, Homo sapiens
  Native (MAGC1_HUMAN)
HSTFEGFPQSLLQIPMT

SEQ ID NO: 249239 - protein, 18 aa, Homo sapiens
  Native (MAGC1_HUMAN)
HSTFEGFPQSLLQIPMTS

SEQ ID NO: 249240 - protein, 19 aa, Homo sapiens
  Native (MAGC1_HUMAN)
HSTFEGFPQSLLQIPMTSS

SEQ ID NO: 249241 - protein, 20 aa, Homo sapiens
  Native (MAGC1_HUMAN)
HSTFEGFPQSLLQIPMTSSF

SEQ ID NO: 249242 - protein, 21 aa, Homo sapiens
  Native (MAGC1_HUMAN)
HSTFEGFPQSLLQIPMTSSFS

SEQ ID NO: 249243 - protein, 22 aa, Homo sapiens
  Native (MAGC1_HUMAN)
HSTFEGFPQSLLQIPMTSSFSS

SEQ ID NO: 249244 - protein, 23 aa, Homo sapiens
  Native (MAGC1_HUMAN)
HSTFEGFPQSLLQIPMTSSFSST

SEQ ID NO: 249245 - protein, 24 aa, Homo sapiens
  Native (MAGC1_HUMAN)
HSTFEGFPQSLLQIPMTSSFSSTL

SEQ ID NO: 249246 - protein, 25 aa, Homo sapiens
  Native (MAGC1_HUMAN)
HSTFEGFPQSLLQIPMTSSFSSTLL

SEQ ID NO: 249247 - protein, 14 aa, Homo sapiens
  Native (MAGC1_HUMAN)
HSTFEGFPQSPLQI

SEQ ID NO: 249248 - protein, 15 aa, Homo sapiens
  Native (MAGC1_HUMAN)
HSTFEGFPQSPLQIP

SEQ ID NO: 249249 - protein, 16 aa, Homo sapiens
  Native (MAGC1_HUMAN)
HSTFEGFPQSPLQIPM

SEQ ID NO: 249250 - protein, 17 aa, Homo sapiens
  Native (MAGC1_HUMAN)
HSTFEGFPQSPLQIPMT

SEQ ID NO: 249251 - protein, 19 aa, Homo sapiens
  Native (MAGC1_HUMAN)
HSTFEGFPQSPLQIPMTSS

SEQ ID NO: 249252 - protein, 20 aa, Homo sapiens
  Native (MAGC1_HUMAN)
HSTFEGFPQSPLQIPMTSSF

SEQ ID NO: 249253 - protein, 21 aa, Homo sapiens
  Native (MAGC1_HUMAN)
HSTFEGFPQSPLQIPMTSSFS

SEQ ID NO: 249254 - protein, 22 aa, Homo sapiens
  Native (MAGC1_HUMAN)
HSTFEGFPQSPLQIPMTSSFSS

SEQ ID NO: 249255 - protein, 23 aa, Homo sapiens
  Native (MAGC1_HUMAN)
HSTFEGFPQSPLQIPMTSSFSST

SEQ ID NO: 249256 - protein, 24 aa, Homo sapiens
  Native (MAGC1_HUMAN)
HSTFEGFPQSPLQIPMTSSFSSTL

SEQ ID NO: 249257 - protein, 25 aa, Homo sapiens
  Native (MAGC1_HUMAN)
HSTFEGFPQSPLQIPMTSSFSSTLL

SEQ ID NO: 249258 - protein, 16 aa, Homo sapiens
  Native (MAGC1_HUMAN)
HSTFEGFPQSPLQIPV

SEQ ID NO: 249259 - protein, 17 aa, Homo sapiens
  Native (MAGC1_HUMAN)
HSTFEGFPQSPLQIPVS

SEQ ID NO: 249260 - protein, 19 aa, Homo sapiens
  Native (MAGC1_HUMAN)
HSTFEGFPQSPLQIPVSSS

SEQ ID NO: 249261 - protein, 20 aa, Homo sapiens
  Native (MAGC1_HUMAN)
HSTFEGFPQSPLQIPVSSSS

SEQ ID NO: 249262 - protein, 21 aa, Homo sapiens
  Native (MAGC1_HUMAN)
HSTFEGFPQSPLQIPVSSSSS

SEQ ID NO: 249263 - protein, 22 aa, Homo sapiens
  Native (MAGC1_HUMAN)
HSTFEGFPQSPLQIPVSSSSSS

SEQ ID NO: 249264 - protein, 23 aa, Homo sapiens
  Native (MAGC1_HUMAN)
HSTFEGFPQSPLQIPVSSSSSSS

SEQ ID NO: 249265 - protein, 24 aa, Homo sapiens
  Native (MAGC1_HUMAN)
HSTFEGFPQSPLQIPVSSSSSSST

SEQ ID NO: 249266 - protein, 25 aa, Homo sapiens
  Native (MAGC1_HUMAN)
HSTFEGFPQSPLQIPVSSSSSSSTL

SEQ ID NO: 249267 - protein, 15 aa, Homo sapiens
  Native (MAGC1_HUMAN)
HYLEYREVPNSSPPR

SEQ ID NO: 249268 - protein, 16 aa, Homo sapiens
  Native (MAGC1_HUMAN)
HYLEYREVPNSSPPRY

SEQ ID NO: 249269 - protein, 17 aa, Homo sapiens
  Native (MAGC1_HUMAN)
HYLEYREVPNSSPPRYE

SEQ ID NO: 249270 - protein, 20 aa, Homo sapiens
  Native (MAGC1_HUMAN)
HYLEYREVPNSSPPRYEFLW

SEQ ID NO: 249271 - protein, 24 aa, Homo sapiens
  Native (MAGC1_HUMAN)
HYLEYREVPNSSPPRYEFLWGPRA

SEQ ID NO: 249272 - protein, 25 aa, Homo sapiens
  Native (MAGC1_HUMAN)
HYLEYREVPNSSPPRYEFLWGPRAH

SEQ ID NO: 249273 - protein, 14 aa, Homo sapiens
  Native (MAGC1_HUMAN)
ICSSSTPSSLPQSF

SEQ ID NO: 249274 - protein, 15 aa, Homo sapiens
  Native (MAGC1_HUMAN)
ICSSSTPSSLPQSFP

SEQ ID NO: 249275 - protein, 16 aa, Homo sapiens
  Native (MAGC1_HUMAN)
ICSSSTPSSLPQSFPE

SEQ ID NO: 249276 - protein, 17 aa, Homo sapiens
  Native (MAGC1_HUMAN)
ICSSSTPSSLPQSFPES

SEQ ID NO: 249277 - protein, 19 aa, Homo sapiens
  Native (MAGC1_HUMAN)
ICSSSTPSSLPQSFPESSQ

SEQ ID NO: 249278 - protein, 20 aa, Homo sapiens
  Native (MAGC1_HUMAN)
ICSSSTPSSLPQSFPESSQS

SEQ ID NO: 249279 - protein, 14 aa, Homo sapiens
  Native (MAGC1_HUMAN)
ICSSSTSLSLPQSF

SEQ ID NO: 249280 - protein, 15 aa, Homo sapiens
  Native (MAGC1_HUMAN)
ICSSSTSLSLPQSFP

SEQ ID NO: 249281 - protein, 16 aa, Homo sapiens
  Native (MAGC1_HUMAN)
ICSSSTSLSLPQSFPE

SEQ ID NO: 249282 - protein, 17 aa, Homo sapiens
  Native (MAGC1_HUMAN)
ICSSSTSLSLPQSFPES

SEQ ID NO: 249283 - protein, 18 aa, Homo sapiens
  Native (MAGC1_HUMAN)
ICSSSTSLSLPQSFPESP

SEQ ID NO: 249284 - protein, 19 aa, Homo sapiens
  Native (MAGC1_HUMAN)
ICSSSTSLSLPQSFPESPQ

SEQ ID NO: 249285 - protein, 20 aa, Homo sapiens
  Native (MAGC1_HUMAN)
ICSSSTSLSLPQSFPESPQS

SEQ ID NO: 249286 - protein, 15 aa, Homo sapiens
  Native (MAGC1_HUMAN)
IDTTDDSTATESASS

SEQ ID NO: 249287 - protein, 16 aa, Homo sapiens
  Native (MAGC1_HUMAN)
IDTTDDSTATESASSS

SEQ ID NO: 249288 - protein, 17 aa, Homo sapiens
  Native (MAGC1_HUMAN)
IDTTDDSTATESASSSV

SEQ ID NO: 249289 - protein, 19 aa, Homo sapiens
  Native (MAGC1_HUMAN)
IDTTDDSTATESASSSVMS

SEQ ID NO: 249290 - protein, 20 aa, Homo sapiens
  Native (MAGC1_HUMAN)
IDTTDDSTATESASSSVMSP

SEQ ID NO: 249291 - protein, 21 aa, Homo sapiens
  Native (MAGC1_HUMAN)
IDTTDDSTATESASSSVMSPS

SEQ ID NO: 249292 - protein, 22 aa, Homo sapiens
  Native (MAGC1_HUMAN)
IDTTDDSTATESASSSVMSPSF

SEQ ID NO: 249293 - protein, 23 aa, Homo sapiens
  Native (MAGC1_HUMAN)
IDTTDDSTATESASSSVMSPSFS

SEQ ID NO: 249294 - protein, 24 aa, Homo sapiens
  Native (MAGC1_HUMAN)
IDTTDDSTATESASSSVMSPSFSS

SEQ ID NO: 249295 - protein, 25 aa, Homo sapiens
  Native (MAGC1_HUMAN)
IDTTDDSTATESASSSVMSPSFSSE

SEQ ID NO: 249296 - protein, 13 aa, Homo sapiens
  Native (MAGC1_HUMAN)
IEILFGISLREVD

SEQ ID NO: 249297 - protein, 14 aa, Homo sapiens
  Native (MAGC1_HUMAN)
IEILFGISLREVDP

SEQ ID NO: 249298 - protein, 15 aa, Homo sapiens
  Native (MAGC1_HUMAN)
IEILFGISLREVDPD

SEQ ID NO: 249299 - protein, 16 aa, Homo sapiens
  Native (MAGC1_HUMAN)
IEILFGISLREVDPDD

SEQ ID NO: 249300 - protein, 17 aa, Homo sapiens
  Native (MAGC1_HUMAN)
IEILFGISLREVDPDDS

SEQ ID NO: 249301 - protein, 18 aa, Homo sapiens
  Native (MAGC1_HUMAN)
IEILFGISLREVDPDDSY

SEQ ID NO: 249302 - protein, 19 aa, Homo sapiens
  Native (MAGC1_HUMAN)
IEILFGISLREVDPDDSYV

SEQ ID NO: 249303 - protein, 20 aa, Homo sapiens
  Native (MAGC1_HUMAN)
IEILFGISLREVDPDDSYVF

SEQ ID NO: 249304 - protein, 21 aa, Homo sapiens
  Native (MAGC1_HUMAN)
IEILFGISLREVDPDDSYVFV

SEQ ID NO: 249305 - protein, 22 aa, Homo sapiens
  Native (MAGC1_HUMAN)
IEILFGISLREVDPDDSYVFVN

SEQ ID NO: 249306 - protein, 23 aa, Homo sapiens
  Native (MAGC1_HUMAN)
IEILFGISLREVDPDDSYVFVNT

SEQ ID NO: 249307 - protein, 24 aa, Homo sapiens
  Native (MAGC1_HUMAN)
IEILFGISLREVDPDDSYVFVNTL

SEQ ID NO: 249308 - protein, 25 aa, Homo sapiens
  Native (MAGC1_HUMAN)
IEILFGISLREVDPDDSYVFVNTLD

SEQ ID NO: 249309 - protein, 14 aa, Homo sapiens
  Native (MAGC1_HUMAN)
IESEPLFTYTLDEK

SEQ ID NO: 249310 - protein, 15 aa, Homo sapiens
  Native (MAGC1_HUMAN)
IESEPLFTYTLDEKV

SEQ ID NO: 249311 - protein, 16 aa, Homo sapiens
  Native (MAGC1_HUMAN)
IESEPLFTYTLDEKVD

SEQ ID NO: 249312 - protein, 17 aa, Homo sapiens
  Native (MAGC1_HUMAN)
IESEPLFTYTLDEKVDE

SEQ ID NO: 249313 - protein, 18 aa, Homo sapiens
  Native (MAGC1_HUMAN)
IESEPLFTYTLDEKVDEL

SEQ ID NO: 249314 - protein, 19 aa, Homo sapiens
  Native (MAGC1_HUMAN)
IESEPLFTYTLDEKVDELA

SEQ ID NO: 249315 - protein, 20 aa, Homo sapiens
  Native (MAGC1_HUMAN)
IESEPLFTYTLDEKVDELAR

SEQ ID NO: 249316 - protein, 21 aa, Homo sapiens
  Native (MAGC1_HUMAN)
IESEPLFTYTLDEKVDELARF

SEQ ID NO: 249317 - protein, 22 aa, Homo sapiens
  Native (MAGC1_HUMAN)
IESEPLFTYTLDEKVDELARFL

SEQ ID NO: 249318 - protein, 23 aa, Homo sapiens
  Native (MAGC1_HUMAN)
IESEPLFTYTLDEKVDELARFLL

SEQ ID NO: 249319 - protein, 24 aa, Homo sapiens
  Native (MAGC1_HUMAN)
IESEPLFTYTLDEKVDELARFLLL

SEQ ID NO: 249320 - protein, 25 aa, Homo sapiens
  Native (MAGC1_HUMAN)
IESEPLFTYTLDEKVDELARFLLLK

SEQ ID NO: 249321 - protein, 13 aa, Homo sapiens
  Native (MAGC1_HUMAN)
IFIKGTYASEEVI

SEQ ID NO: 249322 - protein, 14 aa, Homo sapiens
  Native (MAGC1_HUMAN)
IFIKGTYASEEVIW

SEQ ID NO: 249323 - protein, 15 aa, Homo sapiens
  Native (MAGC1_HUMAN)
IFIKGTYASEEVIWD

SEQ ID NO: 249324 - protein, 16 aa, Homo sapiens
  Native (MAGC1_HUMAN)
IFIKGTYASEEVIWDV

SEQ ID NO: 249325 - protein, 17 aa, Homo sapiens
  Native (MAGC1_HUMAN)
IFIKGTYASEEVIWDVL

SEQ ID NO: 249326 - protein, 18 aa, Homo sapiens
  Native (MAGC1_HUMAN)
IFIKGTYASEEVIWDVLS

SEQ ID NO: 249327 - protein, 19 aa, Homo sapiens
  Native (MAGC1_HUMAN)
IFIKGTYASEEVIWDVLSG

SEQ ID NO: 249328 - protein, 20 aa, Homo sapiens
  Native (MAGC1_HUMAN)
IFIKGTYASEEVIWDVLSGI

SEQ ID NO: 249329 - protein, 21 aa, Homo sapiens
  Native (MAGC1_HUMAN)
IFIKGTYASEEVIWDVLSGIG

SEQ ID NO: 249330 - protein, 22 aa, Homo sapiens
  Native (MAGC1_HUMAN)
IFIKGTYASEEVIWDVLSGIGV

SEQ ID NO: 249331 - protein, 23 aa, Homo sapiens
  Native (MAGC1_HUMAN)
IFIKGTYASEEVIWDVLSGIGVR

SEQ ID NO: 249332 - protein, 24 aa, Homo sapiens
  Native (MAGC1_HUMAN)
IFIKGTYASEEVIWDVLSGIGVRA

SEQ ID NO: 249333 - protein, 25 aa, Homo sapiens
  Native (MAGC1_HUMAN)
IFIKGTYASEEVIWDVLSGIGVRAG

SEQ ID NO: 249334 - protein, 16 aa, Homo sapiens
  Native (MAGC1_HUMAN)
IFQSSPERTQSTFEGF

SEQ ID NO: 249335 - protein, 17 aa, Homo sapiens
  Native (MAGC1_HUMAN)
IFQSSPERTQSTFEGFA

SEQ ID NO: 249336 - protein, 19 aa, Homo sapiens
  Native (MAGC1_HUMAN)
IFQSSPERTQSTFEGFAQS

SEQ ID NO: 249337 - protein, 20 aa, Homo sapiens
  Native (MAGC1_HUMAN)
IFQSSPERTQSTFEGFAQSP

SEQ ID NO: 249338 - protein, 21 aa, Homo sapiens
  Native (MAGC1_HUMAN)
IFQSSPERTQSTFEGFAQSPL

SEQ ID NO: 249339 - protein, 22 aa, Homo sapiens
  Native (MAGC1_HUMAN)
IFQSSPERTQSTFEGFAQSPLQ

SEQ ID NO: 249340 - protein, 23 aa, Homo sapiens
  Native (MAGC1_HUMAN)
IFQSSPERTQSTFEGFAQSPLQI

SEQ ID NO: 249341 - protein, 24 aa, Homo sapiens
  Native (MAGC1_HUMAN)
IFQSSPERTQSTFEGFAQSPLQIP

SEQ ID NO: 249342 - protein, 25 aa, Homo sapiens
  Native (MAGC1_HUMAN)
IFQSSPERTQSTFEGFAQSPLQIPV

SEQ ID NO: 249343 - protein, 14 aa, Homo sapiens
  Native (MAGC1_HUMAN)
IFQSSPESAQSTFE

SEQ ID NO: 249344 - protein, 15 aa, Homo sapiens
  Native (MAGC1_HUMAN)
IFQSSPESAQSTFEG

SEQ ID NO: 249345 - protein, 16 aa, Homo sapiens
  Native (MAGC1_HUMAN)
IFQSSPESAQSTFEGF

SEQ ID NO: 249346 - protein, 17 aa, Homo sapiens
  Native (MAGC1_HUMAN)
IFQSSPESAQSTFEGFP

SEQ ID NO: 249347 - protein, 21 aa, Homo sapiens
  Native (MAGC1_HUMAN)
IFQSSPESAQSTFEGFPQSPL

SEQ ID NO: 249348 - protein, 22 aa, Homo sapiens
  Native (MAGC1_HUMAN)
IFQSSPESAQSTFEGFPQSPLQ

SEQ ID NO: 249349 - protein, 23 aa, Homo sapiens
  Native (MAGC1_HUMAN)
IFQSSPESAQSTFEGFPQSPLQI

SEQ ID NO: 249350 - protein, 24 aa, Homo sapiens
  Native (MAGC1_HUMAN)
IFQSSPESAQSTFEGFPQSPLQIP

SEQ ID NO: 249351 - protein, 25 aa, Homo sapiens
  Native (MAGC1_HUMAN)
IFQSSPESAQSTFEGFPQSPLQIPG

SEQ ID NO: 249352 - protein, 23 aa, Homo sapiens
  Native (MAGC1_HUMAN)
IFQSSPESTQSPFEGFPQSPLQI

SEQ ID NO: 249353 - protein, 24 aa, Homo sapiens
  Native (MAGC1_HUMAN)
IFQSSPESTQSPFEGFPQSPLQIP

SEQ ID NO: 249354 - protein, 25 aa, Homo sapiens
  Native (MAGC1_HUMAN)
IFQSSPESTQSPFEGFPQSPLQIPV

SEQ ID NO: 249355 - protein, 23 aa, Homo sapiens
  Native (MAGC1_HUMAN)
IFQSSPESTQSPFEGFPQSVLQI

SEQ ID NO: 249356 - protein, 24 aa, Homo sapiens
  Native (MAGC1_HUMAN)
IFQSSPESTQSPFEGFPQSVLQIP

SEQ ID NO: 249357 - protein, 25 aa, Homo sapiens
  Native (MAGC1_HUMAN)
IFQSSPESTQSPFEGFPQSVLQIPV

SEQ ID NO: 249358 - protein, 13 aa, Homo sapiens
  Native (MAGC1_HUMAN)
IFRKAREFIEILF

SEQ ID NO: 249359 - protein, 14 aa, Homo sapiens
  Native (MAGC1_HUMAN)
IFRKAREFIEILFG

SEQ ID NO: 249360 - protein, 15 aa, Homo sapiens
  Native (MAGC1_HUMAN)
IFRKAREFIEILFGI

SEQ ID NO: 249361 - protein, 16 aa, Homo sapiens
  Native (MAGC1_HUMAN)
IFRKAREFIEILFGIS

SEQ ID NO: 249362 - protein, 17 aa, Homo sapiens
  Native (MAGC1_HUMAN)
IFRKAREFIEILFGISL

SEQ ID NO: 249363 - protein, 18 aa, Homo sapiens
  Native (MAGC1_HUMAN)
IFRKAREFIEILFGISLR

SEQ ID NO: 249364 - protein, 19 aa, Homo sapiens
  Native (MAGC1_HUMAN)
IFRKAREFIEILFGISLRE

SEQ ID NO: 249365 - protein, 20 aa, Homo sapiens
  Native (MAGC1_HUMAN)
IFRKAREFIEILFGISLREV

SEQ ID NO: 249366 - protein, 21 aa, Homo sapiens
  Native (MAGC1_HUMAN)
IFRKAREFIEILFGISLREVD

SEQ ID NO: 249367 - protein, 22 aa, Homo sapiens
  Native (MAGC1_HUMAN)
IFRKAREFIEILFGISLREVDP

SEQ ID NO: 249368 - protein, 23 aa, Homo sapiens
  Native (MAGC1_HUMAN)
IFRKAREFIEILFGISLREVDPD

SEQ ID NO: 249369 - protein, 24 aa, Homo sapiens
  Native (MAGC1_HUMAN)
IFRKAREFIEILFGISLREVDPDD

SEQ ID NO: 249370 - protein, 25 aa, Homo sapiens
  Native (MAGC1_HUMAN)
IFRKAREFIEILFGISLREVDPDDS

SEQ ID NO: 249371 - protein, 14 aa, Homo sapiens
  Native (MAGC1_HUMAN)
IGVRAGREHFAFGE

SEQ ID NO: 249372 - protein, 15 aa, Homo sapiens
  Native (MAGC1_HUMAN)
IGVRAGREHFAFGEP

SEQ ID NO: 249373 - protein, 16 aa, Homo sapiens
  Native (MAGC1_HUMAN)
IGVRAGREHFAFGEPR

SEQ ID NO: 249374 - protein, 17 aa, Homo sapiens
  Native (MAGC1_HUMAN)
IGVRAGREHFAFGEPRE

SEQ ID NO: 249375 - protein, 18 aa, Homo sapiens
  Native (MAGC1_HUMAN)
IGVRAGREHFAFGEPREL

SEQ ID NO: 249376 - protein, 19 aa, Homo sapiens
  Native (MAGC1_HUMAN)
IGVRAGREHFAFGEPRELL

SEQ ID NO: 249377 - protein, 20 aa, Homo sapiens
  Native (MAGC1_HUMAN)
IGVRAGREHFAFGEPRELLT

SEQ ID NO: 249378 - protein, 21 aa, Homo sapiens
  Native (MAGC1_HUMAN)
IGVRAGREHFAFGEPRELLTK

SEQ ID NO: 249379 - protein, 22 aa, Homo sapiens
  Native (MAGC1_HUMAN)
IGVRAGREHFAFGEPRELLTKV

SEQ ID NO: 249380 - protein, 23 aa, Homo sapiens
  Native (MAGC1_HUMAN)
IGVRAGREHFAFGEPRELLTKVW

SEQ ID NO: 249381 - protein, 24 aa, Homo sapiens
  Native (MAGC1_HUMAN)
IGVRAGREHFAFGEPRELLTKVWV

SEQ ID NO: 249382 - protein, 25 aa, Homo sapiens
  Native (MAGC1_HUMAN)
IGVRAGREHFAFGEPRELLTKVWVQ

SEQ ID NO: 249383 - protein, 17 aa, Homo sapiens
  Native (MAGC1_HUMAN)
IIDTTDDSTATESASSS

SEQ ID NO: 249384 - protein, 19 aa, Homo sapiens
  Native (MAGC1_HUMAN)
IIDTTDDSTATESASSSVM

SEQ ID NO: 249385 - protein, 20 aa, Homo sapiens
  Native (MAGC1_HUMAN)
IIDTTDDSTATESASSSVMS

SEQ ID NO: 249386 - protein, 21 aa, Homo sapiens
  Native (MAGC1_HUMAN)
IIDTTDDSTATESASSSVMSP

SEQ ID NO: 249387 - protein, 22 aa, Homo sapiens
  Native (MAGC1_HUMAN)
IIDTTDDSTATESASSSVMSPS

SEQ ID NO: 249388 - protein, 23 aa, Homo sapiens
  Native (MAGC1_HUMAN)
IIDTTDDSTATESASSSVMSPSF

SEQ ID NO: 249389 - protein, 24 aa, Homo sapiens
  Native (MAGC1_HUMAN)
IIDTTDDSTATESASSSVMSPSFS

SEQ ID NO: 249390 - protein, 25 aa, Homo sapiens
  Native (MAGC1_HUMAN)
IIDTTDDSTATESASSSVMSPSFSS

SEQ ID NO: 249391 - protein, 13 aa, Homo sapiens
  Native (MAGC1_HUMAN)
IIFIKGTYASEEV

SEQ ID NO: 249392 - protein, 14 aa, Homo sapiens
  Native (MAGC1_HUMAN)
IIFIKGTYASEEVI

SEQ ID NO: 249393 - protein, 15 aa, Homo sapiens
  Native (MAGC1_HUMAN)
IIFIKGTYASEEVIW

SEQ ID NO: 249394 - protein, 16 aa, Homo sapiens
  Native (MAGC1_HUMAN)
IIFIKGTYASEEVIWD

SEQ ID NO: 249395 - protein, 17 aa, Homo sapiens
  Native (MAGC1_HUMAN)
IIFIKGTYASEEVIWDV

SEQ ID NO: 249396 - protein, 18 aa, Homo sapiens
  Native (MAGC1_HUMAN)
IIFIKGTYASEEVIWDVL

SEQ ID NO: 249397 - protein, 19 aa, Homo sapiens
  Native (MAGC1_HUMAN)
IIFIKGTYASEEVIWDVLS

SEQ ID NO: 249398 - protein, 20 aa, Homo sapiens
  Native (MAGC1_HUMAN)
IIFIKGTYASEEVIWDVLSG

SEQ ID NO: 249399 - protein, 21 aa, Homo sapiens
  Native (MAGC1_HUMAN)
IIFIKGTYASEEVIWDVLSGI

SEQ ID NO: 249400 - protein, 22 aa, Homo sapiens
  Native (MAGC1_HUMAN)
IIFIKGTYASEEVIWDVLSGIG

SEQ ID NO: 249401 - protein, 23 aa, Homo sapiens
  Native (MAGC1_HUMAN)
IIFIKGTYASEEVIWDVLSGIGV

SEQ ID NO: 249402 - protein, 24 aa, Homo sapiens
  Native (MAGC1_HUMAN)
IIFIKGTYASEEVIWDVLSGIGVR

SEQ ID NO: 249403 - protein, 25 aa, Homo sapiens
  Native (MAGC1_HUMAN)
IIFIKGTYASEEVIWDVLSGIGVRA

SEQ ID NO: 249404 - protein, 14 aa, Homo sapiens
  Native (MAGC1_HUMAN)
IKGTYASEEVIWDV

SEQ ID NO: 249405 - protein, 15 aa, Homo sapiens
  Native (MAGC1_HUMAN)
IKGTYASEEVIWDVL

SEQ ID NO: 249406 - protein, 16 aa, Homo sapiens
  Native (MAGC1_HUMAN)
IKGTYASEEVIWDVLS

SEQ ID NO: 249407 - protein, 17 aa, Homo sapiens
  Native (MAGC1_HUMAN)
IKGTYASEEVIWDVLSG

SEQ ID NO: 249408 - protein, 18 aa, Homo sapiens
  Native (MAGC1_HUMAN)
IKGTYASEEVIWDVLSGI

SEQ ID NO: 249409 - protein, 19 aa, Homo sapiens
  Native (MAGC1_HUMAN)
IKGTYASEEVIWDVLSGIG

SEQ ID NO: 249410 - protein, 20 aa, Homo sapiens
  Native (MAGC1_HUMAN)
IKGTYASEEVIWDVLSGIGV

SEQ ID NO: 249411 - protein, 21 aa, Homo sapiens
  Native (MAGC1_HUMAN)
IKGTYASEEVIWDVLSGIGVR

SEQ ID NO: 249412 - protein, 22 aa, Homo sapiens
  Native (MAGC1_HUMAN)
IKGTYASEEVIWDVLSGIGVRA

SEQ ID NO: 249413 - protein, 23 aa, Homo sapiens
  Native (MAGC1_HUMAN)
IKGTYASEEVIWDVLSGIGVRAG

SEQ ID NO: 249414 - protein, 24 aa, Homo sapiens
  Native (MAGC1_HUMAN)
IKGTYASEEVIWDVLSGIGVRAGR

SEQ ID NO: 249415 - protein, 25 aa, Homo sapiens
  Native (MAGC1_HUMAN)
IKGTYASEEVIWDVLSGIGVRAGRE

SEQ ID NO: 249416 - protein, 13 aa, Homo sapiens
  Native (MAGC1_HUMAN)
IKRKVVEFLAMLK

SEQ ID NO: 249417 - protein, 14 aa, Homo sapiens
  Native (MAGC1_HUMAN)
IKRKVVEFLAMLKN

SEQ ID NO: 249418 - protein, 15 aa, Homo sapiens
  Native (MAGC1_HUMAN)
IKRKVVEFLAMLKNT

SEQ ID NO: 249419 - protein, 16 aa, Homo sapiens
  Native (MAGC1_HUMAN)
IKRKVVEFLAMLKNTV

SEQ ID NO: 249420 - protein, 17 aa, Homo sapiens
  Native (MAGC1_HUMAN)
IKRKVVEFLAMLKNTVP

SEQ ID NO: 249421 - protein, 18 aa, Homo sapiens
  Native (MAGC1_HUMAN)
IKRKVVEFLAMLKNTVPI

SEQ ID NO: 249422 - protein, 19 aa, Homo sapiens
  Native (MAGC1_HUMAN)
IKRKVVEFLAMLKNTVPIT

SEQ ID NO: 249423 - protein, 20 aa, Homo sapiens
  Native (MAGC1_HUMAN)
IKRKVVEFLAMLKNTVPITF

SEQ ID NO: 249424 - protein, 21 aa, Homo sapiens
  Native (MAGC1_HUMAN)
IKRKVVEFLAMLKNTVPITFP

SEQ ID NO: 249425 - protein, 22 aa, Homo sapiens
  Native (MAGC1_HUMAN)
IKRKVVEFLAMLKNTVPITFPS

SEQ ID NO: 249426 - protein, 23 aa, Homo sapiens
  Native (MAGC1_HUMAN)
IKRKVVEFLAMLKNTVPITFPSS

SEQ ID NO: 249427 - protein, 24 aa, Homo sapiens
  Native (MAGC1_HUMAN)
IKRKVVEFLAMLKNTVPITFPSSY

SEQ ID NO: 249428 - protein, 25 aa, Homo sapiens
  Native (MAGC1_HUMAN)
IKRKVVEFLAMLKNTVPITFPSSYK

SEQ ID NO: 249429 - protein, 13 aa, Homo sapiens
  Native (MAGC1_HUMAN)
ILFGISLREVDPD

SEQ ID NO: 249430 - protein, 14 aa, Homo sapiens
  Native (MAGC1_HUMAN)
ILFGISLREVDPDD

SEQ ID NO: 249431 - protein, 15 aa, Homo sapiens
  Native (MAGC1_HUMAN)
ILFGISLREVDPDDS

SEQ ID NO: 249432 - protein, 16 aa, Homo sapiens
  Native (MAGC1_HUMAN)
ILFGISLREVDPDDSY

SEQ ID NO: 249433 - protein, 17 aa, Homo sapiens
  Native (MAGC1_HUMAN)
ILFGISLREVDPDDSYV

SEQ ID NO: 249434 - protein, 18 aa, Homo sapiens
  Native (MAGC1_HUMAN)
ILFGISLREVDPDDSYVF

SEQ ID NO: 249435 - protein, 19 aa, Homo sapiens
  Native (MAGC1_HUMAN)
ILFGISLREVDPDDSYVFV

SEQ ID NO: 249436 - protein, 20 aa, Homo sapiens
  Native (MAGC1_HUMAN)
ILFGISLREVDPDDSYVFVN

SEQ ID NO: 249437 - protein, 21 aa, Homo sapiens
  Native (MAGC1_HUMAN)
ILFGISLREVDPDDSYVFVNT

SEQ ID NO: 249438 - protein, 22 aa, Homo sapiens
  Native (MAGC1_HUMAN)
ILFGISLREVDPDDSYVFVNTL

SEQ ID NO: 249439 - protein, 23 aa, Homo sapiens
  Native (MAGC1_HUMAN)
ILFGISLREVDPDDSYVFVNTLD

SEQ ID NO: 249440 - protein, 24 aa, Homo sapiens
  Native (MAGC1_HUMAN)
ILFGISLREVDPDDSYVFVNTLDL

SEQ ID NO: 249441 - protein, 25 aa, Homo sapiens
  Native (MAGC1_HUMAN)
ILFGISLREVDPDDSYVFVNTLDLT

SEQ ID NO: 249442 - protein, 13 aa, Homo sapiens
  Native (MAGC1_HUMAN)
ILILSIIFIKGTY

SEQ ID NO: 249443 - protein, 14 aa, Homo sapiens
  Native (MAGC1_HUMAN)
ILILSIIFIKGTYA

SEQ ID NO: 249444 - protein, 15 aa, Homo sapiens
  Native (MAGC1_HUMAN)
ILILSIIFIKGTYAS

SEQ ID NO: 249445 - protein, 16 aa, Homo sapiens
  Native (MAGC1_HUMAN)
ILILSIIFIKGTYASE

SEQ ID NO: 249446 - protein, 17 aa, Homo sapiens
  Native (MAGC1_HUMAN)
ILILSIIFIKGTYASEE

SEQ ID NO: 249447 - protein, 18 aa, Homo sapiens
  Native (MAGC1_HUMAN)
ILILSIIFIKGTYASEEV

SEQ ID NO: 249448 - protein, 19 aa, Homo sapiens
  Native (MAGC1_HUMAN)
ILILSIIFIKGTYASEEVI

SEQ ID NO: 249449 - protein, 20 aa, Homo sapiens
  Native (MAGC1_HUMAN)
ILILSIIFIKGTYASEEVIW

SEQ ID NO: 249450 - protein, 21 aa, Homo sapiens
  Native (MAGC1_HUMAN)
ILILSIIFIKGTYASEEVIWD

SEQ ID NO: 249451 - protein, 22 aa, Homo sapiens
  Native (MAGC1_HUMAN)
ILILSIIFIKGTYASEEVIWDV

SEQ ID NO: 249452 - protein, 23 aa, Homo sapiens
  Native (MAGC1_HUMAN)
ILILSIIFIKGTYASEEVIWDVL

SEQ ID NO: 249453 - protein, 24 aa, Homo sapiens
  Native (MAGC1_HUMAN)
ILILSIIFIKGTYASEEVIWDVLS

SEQ ID NO: 249454 - protein, 25 aa, Homo sapiens
  Native (MAGC1_HUMAN)
ILILSIIFIKGTYASEEVIWDVLSG

SEQ ID NO: 249455 - protein, 14 aa, Homo sapiens
  Native (MAGC1_HUMAN)
ILQSSPESAQSAFE

SEQ ID NO: 249456 - protein, 15 aa, Homo sapiens
  Native (MAGC1_HUMAN)
ILQSSPESAQSAFEG

SEQ ID NO: 249457 - protein, 16 aa, Homo sapiens
  Native (MAGC1_HUMAN)
ILQSSPESAQSAFEGF

SEQ ID NO: 249458 - protein, 17 aa, Homo sapiens
  Native (MAGC1_HUMAN)
ILQSSPESAQSAFEGFP

SEQ ID NO: 249459 - protein, 20 aa, Homo sapiens
  Native (MAGC1_HUMAN)
ILQSSPESAQSAFEGFPQSP

SEQ ID NO: 249460 - protein, 21 aa, Homo sapiens
  Native (MAGC1_HUMAN)
ILQSSPESAQSAFEGFPQSPL

SEQ ID NO: 249461 - protein, 22 aa, Homo sapiens
  Native (MAGC1_HUMAN)
ILQSSPESAQSAFEGFPQSPLQ

SEQ ID NO: 249462 - protein, 23 aa, Homo sapiens
  Native (MAGC1_HUMAN)
ILQSSPESAQSAFEGFPQSPLQI

SEQ ID NO: 249463 - protein, 24 aa, Homo sapiens
  Native (MAGC1_HUMAN)
ILQSSPESAQSAFEGFPQSPLQIP

SEQ ID NO: 249464 - protein, 25 aa, Homo sapiens
  Native (MAGC1_HUMAN)
ILQSSPESAQSAFEGFPQSPLQIPV

SEQ ID NO: 249465 - protein, 13 aa, Homo sapiens
  Native (MAGC1_HUMAN)
ILSIIFIKGTYAS

SEQ ID NO: 249466 - protein, 14 aa, Homo sapiens
  Native (MAGC1_HUMAN)
ILSIIFIKGTYASE

SEQ ID NO: 249467 - protein, 15 aa, Homo sapiens
  Native (MAGC1_HUMAN)
ILSIIFIKGTYASEE

SEQ ID NO: 249468 - protein, 16 aa, Homo sapiens
  Native (MAGC1_HUMAN)
ILSIIFIKGTYASEEV

SEQ ID NO: 249469 - protein, 17 aa, Homo sapiens
  Native (MAGC1_HUMAN)
ILSIIFIKGTYASEEVI

SEQ ID NO: 249470 - protein, 18 aa, Homo sapiens
  Native (MAGC1_HUMAN)
ILSIIFIKGTYASEEVIW

SEQ ID NO: 249471 - protein, 19 aa, Homo sapiens
  Native (MAGC1_HUMAN)
ILSIIFIKGTYASEEVIWD

SEQ ID NO: 249472 - protein, 20 aa, Homo sapiens
  Native (MAGC1_HUMAN)
ILSIIFIKGTYASEEVIWDV

SEQ ID NO: 249473 - protein, 21 aa, Homo sapiens
  Native (MAGC1_HUMAN)
ILSIIFIKGTYASEEVIWDVL

SEQ ID NO: 249474 - protein, 22 aa, Homo sapiens
  Native (MAGC1_HUMAN)
ILSIIFIKGTYASEEVIWDVLS

SEQ ID NO: 249475 - protein, 23 aa, Homo sapiens
  Native (MAGC1_HUMAN)
ILSIIFIKGTYASEEVIWDVLSG

SEQ ID NO: 249476 - protein, 24 aa, Homo sapiens
  Native (MAGC1_HUMAN)
ILSIIFIKGTYASEEVIWDVLSGI

SEQ ID NO: 249477 - protein, 25 aa, Homo sapiens
  Native (MAGC1_HUMAN)
ILSIIFIKGTYASEEVIWDVLSGIG

SEQ ID NO: 249478 - protein, 14 aa, Homo sapiens
  Native (MAGC1_HUMAN)
IPGSPSFSSTLLSL

SEQ ID NO: 249479 - protein, 15 aa, Homo sapiens
  Native (MAGC1_HUMAN)
IPGSPSFSSTLLSLF

SEQ ID NO: 249480 - protein, 16 aa, Homo sapiens
  Native (MAGC1_HUMAN)
IPGSPSFSSTLLSLFQ

SEQ ID NO: 249481 - protein, 17 aa, Homo sapiens
  Native (MAGC1_HUMAN)
IPGSPSFSSTLLSLFQS

SEQ ID NO: 249482 - protein, 18 aa, Homo sapiens
  Native (MAGC1_HUMAN)
IPGSPSFSSTLLSLFQSS

SEQ ID NO: 249483 - protein, 19 aa, Homo sapiens
  Native (MAGC1_HUMAN)
IPGSPSFSSTLLSLFQSSP

SEQ ID NO: 249484 - protein, 20 aa, Homo sapiens
  Native (MAGC1_HUMAN)
IPGSPSFSSTLLSLFQSSPE

SEQ ID NO: 249485 - protein, 21 aa, Homo sapiens
  Native (MAGC1_HUMAN)
IPGSPSFSSTLLSLFQSSPER

SEQ ID NO: 249486 - protein, 22 aa, Homo sapiens
  Native (MAGC1_HUMAN)
IPGSPSFSSTLLSLFQSSPERT

SEQ ID NO: 249487 - protein, 23 aa, Homo sapiens
  Native (MAGC1_HUMAN)
IPGSPSFSSTLLSLFQSSPERTH

SEQ ID NO: 249488 - protein, 24 aa, Homo sapiens
  Native (MAGC1_HUMAN)
IPGSPSFSSTLLSLFQSSPERTHS

SEQ ID NO: 249489 - protein, 25 aa, Homo sapiens
  Native (MAGC1_HUMAN)
IPGSPSFSSTLLSLFQSSPERTHST

SEQ ID NO: 249490 - protein, 14 aa, Homo sapiens
  Native (MAGC1_HUMAN)
IPMTSSFSSTLLSI

SEQ ID NO: 249491 - protein, 15 aa, Homo sapiens
  Native (MAGC1_HUMAN)
IPMTSSFSSTLLSIF

SEQ ID NO: 249492 - protein, 16 aa, Homo sapiens
  Native (MAGC1_HUMAN)
IPMTSSFSSTLLSIFQ

SEQ ID NO: 249493 - protein, 17 aa, Homo sapiens
  Native (MAGC1_HUMAN)
IPMTSSFSSTLLSIFQS

SEQ ID NO: 249494 - protein, 18 aa, Homo sapiens
  Native (MAGC1_HUMAN)
IPMTSSFSSTLLSIFQSS

SEQ ID NO: 249495 - protein, 19 aa, Homo sapiens
  Native (MAGC1_HUMAN)
IPMTSSFSSTLLSIFQSSP

SEQ ID NO: 249496 - protein, 20 aa, Homo sapiens
  Native (MAGC1_HUMAN)
IPMTSSFSSTLLSIFQSSPE

SEQ ID NO: 249497 - protein, 21 aa, Homo sapiens
  Native (MAGC1_HUMAN)
IPMTSSFSSTLLSIFQSSPES

SEQ ID NO: 249498 - protein, 22 aa, Homo sapiens
  Native (MAGC1_HUMAN)
IPMTSSFSSTLLSIFQSSPESA

SEQ ID NO: 249499 - protein, 23 aa, Homo sapiens
  Native (MAGC1_HUMAN)
IPMTSSFSSTLLSIFQSSPESAQ

SEQ ID NO: 249500 - protein, 24 aa, Homo sapiens
  Native (MAGC1_HUMAN)
IPMTSSFSSTLLSIFQSSPESAQS

SEQ ID NO: 249501 - protein, 25 aa, Homo sapiens
  Native (MAGC1_HUMAN)
IPMTSSFSSTLLSIFQSSPESAQST

SEQ ID NO: 249502 - protein, 15 aa, Homo sapiens
  Native (MAGC1_HUMAN)
IPMTSSFSSTLLSIL

SEQ ID NO: 249503 - protein, 16 aa, Homo sapiens
  Native (MAGC1_HUMAN)
IPMTSSFSSTLLSILQ

SEQ ID NO: 249504 - protein, 17 aa, Homo sapiens
  Native (MAGC1_HUMAN)
IPMTSSFSSTLLSILQS

SEQ ID NO: 249505 - protein, 18 aa, Homo sapiens
  Native (MAGC1_HUMAN)
IPMTSSFSSTLLSILQSS

SEQ ID NO: 249506 - protein, 19 aa, Homo sapiens
  Native (MAGC1_HUMAN)
IPMTSSFSSTLLSILQSSP

SEQ ID NO: 249507 - protein, 20 aa, Homo sapiens
  Native (MAGC1_HUMAN)
IPMTSSFSSTLLSILQSSPE

SEQ ID NO: 249508 - protein, 21 aa, Homo sapiens
  Native (MAGC1_HUMAN)
IPMTSSFSSTLLSILQSSPES

SEQ ID NO: 249509 - protein, 22 aa, Homo sapiens
  Native (MAGC1_HUMAN)
IPMTSSFSSTLLSILQSSPESA

SEQ ID NO: 249510 - protein, 23 aa, Homo sapiens
  Native (MAGC1_HUMAN)
IPMTSSFSSTLLSILQSSPESAQ

SEQ ID NO: 249511 - protein, 24 aa, Homo sapiens
  Native (MAGC1_HUMAN)
IPMTSSFSSTLLSILQSSPESAQS

SEQ ID NO: 249512 - protein, 25 aa, Homo sapiens
  Native (MAGC1_HUMAN)
IPMTSSFSSTLLSILQSSPESAQSA

SEQ ID NO: 249513 - protein, 20 aa, Homo sapiens
  Native (MAGC1_HUMAN)
IPQSPLEGEDSLSSLHFPQS

SEQ ID NO: 249514 - protein, 21 aa, Homo sapiens
  Native (MAGC1_HUMAN)
IPQSPLEGEDSLSSLHFPQSP

SEQ ID NO: 249515 - protein, 22 aa, Homo sapiens
  Native (MAGC1_HUMAN)
IPQSPLEGEDSLSSLHFPQSPP

SEQ ID NO: 249516 - protein, 23 aa, Homo sapiens
  Native (MAGC1_HUMAN)
IPQSPLEGEDSLSSLHFPQSPPE

SEQ ID NO: 249517 - protein, 24 aa, Homo sapiens
  Native (MAGC1_HUMAN)
IPQSPLEGEDSLSSLHFPQSPPEW

SEQ ID NO: 249518 - protein, 25 aa, Homo sapiens
  Native (MAGC1_HUMAN)
IPQSPLEGEDSLSSLHFPQSPPEWE

SEQ ID NO: 249519 - protein, 20 aa, Homo sapiens
  Native (MAGC1_HUMAN)
IPQSPPEGENTHSPLQIVPS

SEQ ID NO: 249520 - protein, 21 aa, Homo sapiens
  Native (MAGC1_HUMAN)
IPQSPPEGENTHSPLQIVPSL

SEQ ID NO: 249521 - protein, 22 aa, Homo sapiens
  Native (MAGC1_HUMAN)
IPQSPPEGENTHSPLQIVPSLP

SEQ ID NO: 249522 - protein, 23 aa, Homo sapiens
  Native (MAGC1_HUMAN)
IPQSPPEGENTHSPLQIVPSLPE

SEQ ID NO: 249523 - protein, 24 aa, Homo sapiens
  Native (MAGC1_HUMAN)
IPQSPPEGENTHSPLQIVPSLPEW

SEQ ID NO: 249524 - protein, 25 aa, Homo sapiens
  Native (MAGC1_HUMAN)
IPQSPPEGENTHSPLQIVPSLPEWE

SEQ ID NO: 249525 - protein, 21 aa, Homo sapiens
  Native (MAGC1_HUMAN)
IPQSSPESDDTLYPLQSPQSR

SEQ ID NO: 249526 - protein, 22 aa, Homo sapiens
  Native (MAGC1_HUMAN)
IPQSSPESDDTLYPLQSPQSRS

SEQ ID NO: 249527 - protein, 23 aa, Homo sapiens
  Native (MAGC1_HUMAN)
IPQSSPESDDTLYPLQSPQSRSE

SEQ ID NO: 249528 - protein, 24 aa, Homo sapiens
  Native (MAGC1_HUMAN)
IPQSSPESDDTLYPLQSPQSRSEG

SEQ ID NO: 249529 - protein, 25 aa, Homo sapiens
  Native (MAGC1_HUMAN)
IPQSSPESDDTLYPLQSPQSRSEGE

SEQ ID NO: 249530 - protein, 13 aa, Homo sapiens
  Native (MAGC1_HUMAN)
IPVSAASSSTLVS

SEQ ID NO: 249531 - protein, 14 aa, Homo sapiens
  Native (MAGC1_HUMAN)
IPVSAASSSTLVSI

SEQ ID NO: 249532 - protein, 15 aa, Homo sapiens
  Native (MAGC1_HUMAN)
IPVSAASSSTLVSIF

SEQ ID NO: 249533 - protein, 16 aa, Homo sapiens
  Native (MAGC1_HUMAN)
IPVSAASSSTLVSIFQ

SEQ ID NO: 249534 - protein, 17 aa, Homo sapiens
  Native (MAGC1_HUMAN)
IPVSAASSSTLVSIFQS

SEQ ID NO: 249535 - protein, 18 aa, Homo sapiens
  Native (MAGC1_HUMAN)
IPVSAASSSTLVSIFQSS

SEQ ID NO: 249536 - protein, 19 aa, Homo sapiens
  Native (MAGC1_HUMAN)
IPVSAASSSTLVSIFQSSP

SEQ ID NO: 249537 - protein, 20 aa, Homo sapiens
  Native (MAGC1_HUMAN)
IPVSAASSSTLVSIFQSSPE

SEQ ID NO: 249538 - protein, 21 aa, Homo sapiens
  Native (MAGC1_HUMAN)
IPVSAASSSTLVSIFQSSPES

SEQ ID NO: 249539 - protein, 22 aa, Homo sapiens
  Native (MAGC1_HUMAN)
IPVSAASSSTLVSIFQSSPEST

SEQ ID NO: 249540 - protein, 23 aa, Homo sapiens
  Native (MAGC1_HUMAN)
IPVSAASSSTLVSIFQSSPESTQ

SEQ ID NO: 249541 - protein, 24 aa, Homo sapiens
  Native (MAGC1_HUMAN)
IPVSAASSSTLVSIFQSSPESTQS

SEQ ID NO: 249542 - protein, 25 aa, Homo sapiens
  Native (MAGC1_HUMAN)
IPVSAASSSTLVSIFQSSPESTQSP

SEQ ID NO: 249543 - protein, 14 aa, Homo sapiens
  Native (MAGC1_HUMAN)
IPVSPSFSSTLVSL

SEQ ID NO: 249544 - protein, 15 aa, Homo sapiens
  Native (MAGC1_HUMAN)
IPVSPSFSSTLVSLF

SEQ ID NO: 249545 - protein, 16 aa, Homo sapiens
  Native (MAGC1_HUMAN)
IPVSPSFSSTLVSLFQ

SEQ ID NO: 249546 - protein, 17 aa, Homo sapiens
  Native (MAGC1_HUMAN)
IPVSPSFSSTLVSLFQS

SEQ ID NO: 249547 - protein, 18 aa, Homo sapiens
  Native (MAGC1_HUMAN)
IPVSPSFSSTLVSLFQSS

SEQ ID NO: 249548 - protein, 19 aa, Homo sapiens
  Native (MAGC1_HUMAN)
IPVSPSFSSTLVSLFQSSP

SEQ ID NO: 249549 - protein, 20 aa, Homo sapiens
  Native (MAGC1_HUMAN)
IPVSPSFSSTLVSLFQSSPE

SEQ ID NO: 249550 - protein, 21 aa, Homo sapiens
  Native (MAGC1_HUMAN)
IPVSPSFSSTLVSLFQSSPER

SEQ ID NO: 249551 - protein, 22 aa, Homo sapiens
  Native (MAGC1_HUMAN)
IPVSPSFSSTLVSLFQSSPERT

SEQ ID NO: 249552 - protein, 23 aa, Homo sapiens
  Native (MAGC1_HUMAN)
IPVSPSFSSTLVSLFQSSPERTQ

SEQ ID NO: 249553 - protein, 24 aa, Homo sapiens
  Native (MAGC1_HUMAN)
IPVSPSFSSTLVSLFQSSPERTQS

SEQ ID NO: 249554 - protein, 25 aa, Homo sapiens
  Native (MAGC1_HUMAN)
IPVSPSFSSTLVSLFQSSPERTQST

SEQ ID NO: 249555 - protein, 13 aa, Homo sapiens
  Native (MAGC1_HUMAN)
IPVSPSSSSTLLS

SEQ ID NO: 249556 - protein, 14 aa, Homo sapiens
  Native (MAGC1_HUMAN)
IPVSPSSSSTLLSL

SEQ ID NO: 249557 - protein, 15 aa, Homo sapiens
  Native (MAGC1_HUMAN)
IPVSPSSSSTLLSLF

SEQ ID NO: 249558 - protein, 16 aa, Homo sapiens
  Native (MAGC1_HUMAN)
IPVSPSSSSTLLSLFQ

SEQ ID NO: 249559 - protein, 17 aa, Homo sapiens
  Native (MAGC1_HUMAN)
IPVSPSSSSTLLSLFQS

SEQ ID NO: 249560 - protein, 18 aa, Homo sapiens
  Native (MAGC1_HUMAN)
IPVSPSSSSTLLSLFQSF

SEQ ID NO: 249561 - protein, 19 aa, Homo sapiens
  Native (MAGC1_HUMAN)
IPVSPSSSSTLLSLFQSFS

SEQ ID NO: 249562 - protein, 20 aa, Homo sapiens
  Native (MAGC1_HUMAN)
IPVSPSSSSTLLSLFQSFSE

SEQ ID NO: 249563 - protein, 21 aa, Homo sapiens
  Native (MAGC1_HUMAN)
IPVSPSSSSTLLSLFQSFSER

SEQ ID NO: 249564 - protein, 22 aa, Homo sapiens
  Native (MAGC1_HUMAN)
IPVSPSSSSTLLSLFQSFSERT

SEQ ID NO: 249565 - protein, 23 aa, Homo sapiens
  Native (MAGC1_HUMAN)
IPVSPSSSSTLLSLFQSFSERTQ

SEQ ID NO: 249566 - protein, 24 aa, Homo sapiens
  Native (MAGC1_HUMAN)
IPVSPSSSSTLLSLFQSFSERTQS

SEQ ID NO: 249567 - protein, 25 aa, Homo sapiens
  Native (MAGC1_HUMAN)
IPVSPSSSSTLLSLFQSFSERTQST

SEQ ID NO: 249568 - protein, 14 aa, Homo sapiens
  Native (MAGC1_HUMAN)
IPVSRSFSSTLLSI

SEQ ID NO: 249569 - protein, 15 aa, Homo sapiens
  Native (MAGC1_HUMAN)
IPVSRSFSSTLLSIF

SEQ ID NO: 249570 - protein, 16 aa, Homo sapiens
  Native (MAGC1_HUMAN)
IPVSRSFSSTLLSIFQ

SEQ ID NO: 249571 - protein, 17 aa, Homo sapiens
  Native (MAGC1_HUMAN)
IPVSRSFSSTLLSIFQS

SEQ ID NO: 249572 - protein, 18 aa, Homo sapiens
  Native (MAGC1_HUMAN)
IPVSRSFSSTLLSIFQSS

SEQ ID NO: 249573 - protein, 19 aa, Homo sapiens
  Native (MAGC1_HUMAN)
IPVSRSFSSTLLSIFQSSP

SEQ ID NO: 249574 - protein, 20 aa, Homo sapiens
  Native (MAGC1_HUMAN)
IPVSRSFSSTLLSIFQSSPE

SEQ ID NO: 249575 - protein, 21 aa, Homo sapiens
  Native (MAGC1_HUMAN)
IPVSRSFSSTLLSIFQSSPER

SEQ ID NO: 249576 - protein, 22 aa, Homo sapiens
  Native (MAGC1_HUMAN)
IPVSRSFSSTLLSIFQSSPERT

SEQ ID NO: 249577 - protein, 23 aa, Homo sapiens
  Native (MAGC1_HUMAN)
IPVSRSFSSTLLSIFQSSPERTQ

SEQ ID NO: 249578 - protein, 24 aa, Homo sapiens
  Native (MAGC1_HUMAN)
IPVSRSFSSTLLSIFQSSPERTQS

SEQ ID NO: 249579 - protein, 25 aa, Homo sapiens
  Native (MAGC1_HUMAN)
IPVSRSFSSTLLSIFQSSPERTQST

SEQ ID NO: 249580 - protein, 14 aa, Homo sapiens
  Native (MAGC1_HUMAN)
IPVSSSFSYTLLSL

SEQ ID NO: 249581 - protein, 15 aa, Homo sapiens
  Native (MAGC1_HUMAN)
IPVSSSFSYTLLSLF

SEQ ID NO: 249582 - protein, 16 aa, Homo sapiens
  Native (MAGC1_HUMAN)
IPVSSSFSYTLLSLFQ

SEQ ID NO: 249583 - protein, 17 aa, Homo sapiens
  Native (MAGC1_HUMAN)
IPVSSSFSYTLLSLFQS

SEQ ID NO: 249584 - protein, 18 aa, Homo sapiens
  Native (MAGC1_HUMAN)
IPVSSSFSYTLLSLFQSS

SEQ ID NO: 249585 - protein, 19 aa, Homo sapiens
  Native (MAGC1_HUMAN)
IPVSSSFSYTLLSLFQSSP

SEQ ID NO: 249586 - protein, 20 aa, Homo sapiens
  Native (MAGC1_HUMAN)
IPVSSSFSYTLLSLFQSSPE

SEQ ID NO: 249587 - protein, 21 aa, Homo sapiens
  Native (MAGC1_HUMAN)
IPVSSSFSYTLLSLFQSSPER

SEQ ID NO: 249588 - protein, 22 aa, Homo sapiens
  Native (MAGC1_HUMAN)
IPVSSSFSYTLLSLFQSSPERT

SEQ ID NO: 249589 - protein, 23 aa, Homo sapiens
  Native (MAGC1_HUMAN)
IPVSSSFSYTLLSLFQSSPERTH

SEQ ID NO: 249590 - protein, 24 aa, Homo sapiens
  Native (MAGC1_HUMAN)
IPVSSSFSYTLLSLFQSSPERTHS

SEQ ID NO: 249591 - protein, 25 aa, Homo sapiens
  Native (MAGC1_HUMAN)
IPVSSSFSYTLLSLFQSSPERTHST

SEQ ID NO: 249592 - protein, 13 aa, Homo sapiens
  Native (MAGC1_HUMAN)
IPVSSSSSSSTLL

SEQ ID NO: 249593 - protein, 14 aa, Homo sapiens
  Native (MAGC1_HUMAN)
IPVSSSSSSSTLLS

SEQ ID NO: 249594 - protein, 15 aa, Homo sapiens
  Native (MAGC1_HUMAN)
IPVSSSSSSSTLLSL

SEQ ID NO: 249595 - protein, 16 aa, Homo sapiens
  Native (MAGC1_HUMAN)
IPVSSSSSSSTLLSLF

SEQ ID NO: 249596 - protein, 17 aa, Homo sapiens
  Native (MAGC1_HUMAN)
IPVSSSSSSSTLLSLFQ

SEQ ID NO: 249597 - protein, 18 aa, Homo sapiens
  Native (MAGC1_HUMAN)
IPVSSSSSSSTLLSLFQS

SEQ ID NO: 249598 - protein, 19 aa, Homo sapiens
  Native (MAGC1_HUMAN)
IPVSSSSSSSTLLSLFQSS

SEQ ID NO: 249599 - protein, 20 aa, Homo sapiens
  Native (MAGC1_HUMAN)
IPVSSSSSSSTLLSLFQSSP

SEQ ID NO: 249600 - protein, 21 aa, Homo sapiens
  Native (MAGC1_HUMAN)
IPVSSSSSSSTLLSLFQSSPE

SEQ ID NO: 249601 - protein, 22 aa, Homo sapiens
  Native (MAGC1_HUMAN)
IPVSSSSSSSTLLSLFQSSPEC

SEQ ID NO: 249602 - protein, 23 aa, Homo sapiens
  Native (MAGC1_HUMAN)
IPVSSSSSSSTLLSLFQSSPECT

SEQ ID NO: 249603 - protein, 24 aa, Homo sapiens
  Native (MAGC1_HUMAN)
IPVSSSSSSSTLLSLFQSSPECTQ

SEQ ID NO: 249604 - protein, 25 aa, Homo sapiens
  Native (MAGC1_HUMAN)
IPVSSSSSSSTLLSLFQSSPECTQS

SEQ ID NO: 249605 - protein, 13 aa, Homo sapiens
  Native (MAGC1_HUMAN)
IPVSSSSSSTLLS

SEQ ID NO: 249606 - protein, 14 aa, Homo sapiens
  Native (MAGC1_HUMAN)
IPVSSSSSSTLLSL

SEQ ID NO: 249607 - protein, 15 aa, Homo sapiens
  Native (MAGC1_HUMAN)
IPVSSSSSSTLLSLF

SEQ ID NO: 249608 - protein, 16 aa, Homo sapiens
  Native (MAGC1_HUMAN)
IPVSSSSSSTLLSLFQ

SEQ ID NO: 249609 - protein, 17 aa, Homo sapiens
  Native (MAGC1_HUMAN)
IPVSSSSSSTLLSLFQS

SEQ ID NO: 249610 - protein, 18 aa, Homo sapiens
  Native (MAGC1_HUMAN)
IPVSSSSSSTLLSLFQSS

SEQ ID NO: 249611 - protein, 19 aa, Homo sapiens
  Native (MAGC1_HUMAN)
IPVSSSSSSTLLSLFQSSP

SEQ ID NO: 249612 - protein, 20 aa, Homo sapiens
  Native (MAGC1_HUMAN)
IPVSSSSSSTLLSLFQSSPE

SEQ ID NO: 249613 - protein, 21 aa, Homo sapiens
  Native (MAGC1_HUMAN)
IPVSSSSSSTLLSLFQSSPER

SEQ ID NO: 249614 - protein, 22 aa, Homo sapiens
  Native (MAGC1_HUMAN)
IPVSSSSSSTLLSLFQSSPERT

SEQ ID NO: 249615 - protein, 23 aa, Homo sapiens
  Native (MAGC1_HUMAN)
IPVSSSSSSTLLSLFQSSPERTH

SEQ ID NO: 249616 - protein, 24 aa, Homo sapiens
  Native (MAGC1_HUMAN)
IPVSSSSSSTLLSLFQSSPERTHS

SEQ ID NO: 249617 - protein, 25 aa, Homo sapiens
  Native (MAGC1_HUMAN)
IPVSSSSSSTLLSLFQSSPERTHST

SEQ ID NO: 249618 - protein, 13 aa, Homo sapiens
  Native (MAGC1_HUMAN)
ISFSSSTSLSPFS

SEQ ID NO: 249619 - protein, 14 aa, Homo sapiens
  Native (MAGC1_HUMAN)
ISFSSSTSLSPFSE

SEQ ID NO: 249620 - protein, 15 aa, Homo sapiens
  Native (MAGC1_HUMAN)
ISFSSSTSLSPFSEE

SEQ ID NO: 249621 - protein, 16 aa, Homo sapiens
  Native (MAGC1_HUMAN)
ISFSSSTSLSPFSEES

SEQ ID NO: 249622 - protein, 17 aa, Homo sapiens
  Native (MAGC1_HUMAN)
ISFSSSTSLSPFSEESS

SEQ ID NO: 249623 - protein, 18 aa, Homo sapiens
  Native (MAGC1_HUMAN)
ISFSSSTSLSPFSEESSS

SEQ ID NO: 249624 - protein, 19 aa, Homo sapiens
  Native (MAGC1_HUMAN)
ISFSSSTSLSPFSEESSSP

SEQ ID NO: 249625 - protein, 20 aa, Homo sapiens
  Native (MAGC1_HUMAN)
ISFSSSTSLSPFSEESSSPV

SEQ ID NO: 249626 - protein, 21 aa, Homo sapiens
  Native (MAGC1_HUMAN)
ISFSSSTSLSPFSEESSSPVD

SEQ ID NO: 249627 - protein, 22 aa, Homo sapiens
  Native (MAGC1_HUMAN)
ISFSSSTSLSPFSEESSSPVDE

SEQ ID NO: 249628 - protein, 23 aa, Homo sapiens
  Native (MAGC1_HUMAN)
ISFSSSTSLSPFSEESSSPVDEY

SEQ ID NO: 249629 - protein, 24 aa, Homo sapiens
  Native (MAGC1_HUMAN)
ISFSSSTSLSPFSEESSSPVDEYT

SEQ ID NO: 249630 - protein, 25 aa, Homo sapiens
  Native (MAGC1_HUMAN)
ISFSSSTSLSPFSEESSSPVDEYTS

SEQ ID NO: 249631 - protein, 15 aa, Homo sapiens
  Native (MAGC1_HUMAN)
ISLREVDPDDSYVFV

SEQ ID NO: 249632 - protein, 20 aa, Homo sapiens
  Native (MAGC1_HUMAN)
ISLREVDPDDSYVFVNTLDL

SEQ ID NO: 249633 - protein, 21 aa, Homo sapiens
  Native (MAGC1_HUMAN)
ISLREVDPDDSYVFVNTLDLT

SEQ ID NO: 249634 - protein, 22 aa, Homo sapiens
  Native (MAGC1_HUMAN)
ISLREVDPDDSYVFVNTLDLTS

SEQ ID NO: 249635 - protein, 23 aa, Homo sapiens
  Native (MAGC1_HUMAN)
ISLREVDPDDSYVFVNTLDLTSE

SEQ ID NO: 249636 - protein, 24 aa, Homo sapiens
  Native (MAGC1_HUMAN)
ISLREVDPDDSYVFVNTLDLTSEG

SEQ ID NO: 249637 - protein, 25 aa, Homo sapiens
  Native (MAGC1_HUMAN)
ISLREVDPDDSYVFVNTLDLTSEGC

SEQ ID NO: 249638 - protein, 13 aa, Homo sapiens
  Native (MAGC1_HUMAN)
ISRYTGYFPVIFR

SEQ ID NO: 249639 - protein, 14 aa, Homo sapiens
  Native (MAGC1_HUMAN)
ISRYTGYFPVIFRK

SEQ ID NO: 249640 - protein, 15 aa, Homo sapiens
  Native (MAGC1_HUMAN)
ISRYTGYFPVIFRKA

SEQ ID NO: 249641 - protein, 16 aa, Homo sapiens
  Native (MAGC1_HUMAN)
ISRYTGYFPVIFRKAR

SEQ ID NO: 249642 - protein, 17 aa, Homo sapiens
  Native (MAGC1_HUMAN)
ISRYTGYFPVIFRKARE

SEQ ID NO: 249643 - protein, 18 aa, Homo sapiens
  Native (MAGC1_HUMAN)
ISRYTGYFPVIFRKAREF

SEQ ID NO: 249644 - protein, 19 aa, Homo sapiens
  Native (MAGC1_HUMAN)
ISRYTGYFPVIFRKAREFI

SEQ ID NO: 249645 - protein, 20 aa, Homo sapiens
  Native (MAGC1_HUMAN)
ISRYTGYFPVIFRKAREFIE

SEQ ID NO: 249646 - protein, 21 aa, Homo sapiens
  Native (MAGC1_HUMAN)
ISRYTGYFPVIFRKAREFIEI

SEQ ID NO: 249647 - protein, 22 aa, Homo sapiens
  Native (MAGC1_HUMAN)
ISRYTGYFPVIFRKAREFIEIL

SEQ ID NO: 249648 - protein, 23 aa, Homo sapiens
  Native (MAGC1_HUMAN)
ISRYTGYFPVIFRKAREFIEILF

SEQ ID NO: 249649 - protein, 24 aa, Homo sapiens
  Native (MAGC1_HUMAN)
ISRYTGYFPVIFRKAREFIEILFG

SEQ ID NO: 249650 - protein, 25 aa, Homo sapiens
  Native (MAGC1_HUMAN)
ISRYTGYFPVIFRKAREFIEILFGI

SEQ ID NO: 249651 - protein, 14 aa, Homo sapiens
  Native (MAGC1_HUMAN)
ITKAEMLTNVISRY

SEQ ID NO: 249652 - protein, 15 aa, Homo sapiens
  Native (MAGC1_HUMAN)
ITKAEMLTNVISRYT

SEQ ID NO: 249653 - protein, 16 aa, Homo sapiens
  Native (MAGC1_HUMAN)
ITKAEMLTNVISRYTG

SEQ ID NO: 249654 - protein, 17 aa, Homo sapiens
  Native (MAGC1_HUMAN)
ITKAEMLTNVISRYTGY

SEQ ID NO: 249655 - protein, 18 aa, Homo sapiens
  Native (MAGC1_HUMAN)
ITKAEMLTNVISRYTGYF

SEQ ID NO: 249656 - protein, 19 aa, Homo sapiens
  Native (MAGC1_HUMAN)
ITKAEMLTNVISRYTGYFP

SEQ ID NO: 249657 - protein, 20 aa, Homo sapiens
  Native (MAGC1_HUMAN)
ITKAEMLTNVISRYTGYFPV

SEQ ID NO: 249658 - protein, 21 aa, Homo sapiens
  Native (MAGC1_HUMAN)
ITKAEMLTNVISRYTGYFPVI

SEQ ID NO: 249659 - protein, 22 aa, Homo sapiens
  Native (MAGC1_HUMAN)
ITKAEMLTNVISRYTGYFPVIF

SEQ ID NO: 249660 - protein, 23 aa, Homo sapiens
  Native (MAGC1_HUMAN)
ITKAEMLTNVISRYTGYFPVIFR

SEQ ID NO: 249661 - protein, 24 aa, Homo sapiens
  Native (MAGC1_HUMAN)
ITKAEMLTNVISRYTGYFPVIFRK

SEQ ID NO: 249662 - protein, 25 aa, Homo sapiens
  Native (MAGC1_HUMAN)
ITKAEMLTNVISRYTGYFPVIFRKA

SEQ ID NO: 249663 - protein, 20 aa, Homo sapiens
  Native (MAGC1_HUMAN)
IVPSLPEWEDSLSPHYFPQS

SEQ ID NO: 249664 - protein, 13 aa, Homo sapiens
  Native (MAGC1_HUMAN)
IWDVLSGIGVRAG

SEQ ID NO: 249665 - protein, 14 aa, Homo sapiens
  Native (MAGC1_HUMAN)
IWDVLSGIGVRAGR

SEQ ID NO: 249666 - protein, 15 aa, Homo sapiens
  Native (MAGC1_HUMAN)
IWDVLSGIGVRAGRE

SEQ ID NO: 249667 - protein, 16 aa, Homo sapiens
  Native (MAGC1_HUMAN)
IWDVLSGIGVRAGREH

SEQ ID NO: 249668 - protein, 17 aa, Homo sapiens
  Native (MAGC1_HUMAN)
IWDVLSGIGVRAGREHF

SEQ ID NO: 249669 - protein, 18 aa, Homo sapiens
  Native (MAGC1_HUMAN)
IWDVLSGIGVRAGREHFA

SEQ ID NO: 249670 - protein, 19 aa, Homo sapiens
  Native (MAGC1_HUMAN)
IWDVLSGIGVRAGREHFAF

SEQ ID NO: 249671 - protein, 20 aa, Homo sapiens
  Native (MAGC1_HUMAN)
IWDVLSGIGVRAGREHFAFG

SEQ ID NO: 249672 - protein, 21 aa, Homo sapiens
  Native (MAGC1_HUMAN)
IWDVLSGIGVRAGREHFAFGE

SEQ ID NO: 249673 - protein, 22 aa, Homo sapiens
  Native (MAGC1_HUMAN)
IWDVLSGIGVRAGREHFAFGEP

SEQ ID NO: 249674 - protein, 23 aa, Homo sapiens
  Native (MAGC1_HUMAN)
IWDVLSGIGVRAGREHFAFGEPR

SEQ ID NO: 249675 - protein, 24 aa, Homo sapiens
  Native (MAGC1_HUMAN)
IWDVLSGIGVRAGREHFAFGEPRE

SEQ ID NO: 249676 - protein, 25 aa, Homo sapiens
  Native (MAGC1_HUMAN)
IWDVLSGIGVRAGREHFAFGEPREL

SEQ ID NO: 249677 - protein, 13 aa, Homo sapiens
  Native (MAGC1_HUMAN)
KAEMLTNVISRYT

SEQ ID NO: 249678 - protein, 14 aa, Homo sapiens
  Native (MAGC1_HUMAN)
KAEMLTNVISRYTG

SEQ ID NO: 249679 - protein, 15 aa, Homo sapiens
  Native (MAGC1_HUMAN)
KAEMLTNVISRYTGY

SEQ ID NO: 249680 - protein, 16 aa, Homo sapiens
  Native (MAGC1_HUMAN)
KAEMLTNVISRYTGYF

SEQ ID NO: 249681 - protein, 17 aa, Homo sapiens
  Native (MAGC1_HUMAN)
KAEMLTNVISRYTGYFP

SEQ ID NO: 249682 - protein, 18 aa, Homo sapiens
  Native (MAGC1_HUMAN)
KAEMLTNVISRYTGYFPV

SEQ ID NO: 249683 - protein, 19 aa, Homo sapiens
  Native (MAGC1_HUMAN)
KAEMLTNVISRYTGYFPVI

SEQ ID NO: 249684 - protein, 20 aa, Homo sapiens
  Native (MAGC1_HUMAN)
KAEMLTNVISRYTGYFPVIF

SEQ ID NO: 249685 - protein, 21 aa, Homo sapiens
  Native (MAGC1_HUMAN)
KAEMLTNVISRYTGYFPVIFR

SEQ ID NO: 249686 - protein, 22 aa, Homo sapiens
  Native (MAGC1_HUMAN)
KAEMLTNVISRYTGYFPVIFRK

SEQ ID NO: 249687 - protein, 23 aa, Homo sapiens
  Native (MAGC1_HUMAN)
KAEMLTNVISRYTGYFPVIFRKA

SEQ ID NO: 249688 - protein, 24 aa, Homo sapiens
  Native (MAGC1_HUMAN)
KAEMLTNVISRYTGYFPVIFRKAR

SEQ ID NO: 249689 - protein, 25 aa, Homo sapiens
  Native (MAGC1_HUMAN)
KAEMLTNVISRYTGYFPVIFRKARE

SEQ ID NO: 249690 - protein, 13 aa, Homo sapiens
  Native (MAGC1_HUMAN)
KAREFIEILFGIS

SEQ ID NO: 249691 - protein, 14 aa, Homo sapiens
  Native (MAGC1_HUMAN)
KAREFIEILFGISL

SEQ ID NO: 249692 - protein, 15 aa, Homo sapiens
  Native (MAGC1_HUMAN)
KAREFIEILFGISLR

SEQ ID NO: 249693 - protein, 16 aa, Homo sapiens
  Native (MAGC1_HUMAN)
KAREFIEILFGISLRE

SEQ ID NO: 249694 - protein, 17 aa, Homo sapiens
  Native (MAGC1_HUMAN)
KAREFIEILFGISLREV

SEQ ID NO: 249695 - protein, 18 aa, Homo sapiens
  Native (MAGC1_HUMAN)
KAREFIEILFGISLREVD

SEQ ID NO: 249696 - protein, 19 aa, Homo sapiens
  Native (MAGC1_HUMAN)
KAREFIEILFGISLREVDP

SEQ ID NO: 249697 - protein, 20 aa, Homo sapiens
  Native (MAGC1_HUMAN)
KAREFIEILFGISLREVDPD

SEQ ID NO: 249698 - protein, 21 aa, Homo sapiens
  Native (MAGC1_HUMAN)
KAREFIEILFGISLREVDPDD

SEQ ID NO: 249699 - protein, 22 aa, Homo sapiens
  Native (MAGC1_HUMAN)
KAREFIEILFGISLREVDPDDS

SEQ ID NO: 249700 - protein, 23 aa, Homo sapiens
  Native (MAGC1_HUMAN)
KAREFIEILFGISLREVDPDDSY

SEQ ID NO: 249701 - protein, 24 aa, Homo sapiens
  Native (MAGC1_HUMAN)
KAREFIEILFGISLREVDPDDSYV

SEQ ID NO: 249702 - protein, 25 aa, Homo sapiens
  Native (MAGC1_HUMAN)
KAREFIEILFGISLREVDPDDSYVF

SEQ ID NO: 249703 - protein, 24 aa, Homo sapiens
  Native (MAGC1_HUMAN)
KDALKDVEERAQAIIDTTDDSTAT

SEQ ID NO: 249704 - protein, 25 aa, Homo sapiens
  Native (MAGC1_HUMAN)
KDALKDVEERAQAIIDTTDDSTATE

SEQ ID NO: 249705 - protein, 13 aa, Homo sapiens
  Native (MAGC1_HUMAN)
KDMPTAGMPSLLQ

SEQ ID NO: 249706 - protein, 14 aa, Homo sapiens
  Native (MAGC1_HUMAN)
KDMPTAGMPSLLQS

SEQ ID NO: 249707 - protein, 16 aa, Homo sapiens
  Native (MAGC1_HUMAN)
KDMPTAGMPSLLQSSS

SEQ ID NO: 249708 - protein, 17 aa, Homo sapiens
  Native (MAGC1_HUMAN)
KDMPTAGMPSLLQSSSE

SEQ ID NO: 249709 - protein, 18 aa, Homo sapiens
  Native (MAGC1_HUMAN)
KDMPTAGMPSLLQSSSES

SEQ ID NO: 249710 - protein, 19 aa, Homo sapiens
  Native (MAGC1_HUMAN)
KDMPTAGMPSLLQSSSESP

SEQ ID NO: 249711 - protein, 20 aa, Homo sapiens
  Native (MAGC1_HUMAN)
KDMPTAGMPSLLQSSSESPQ

SEQ ID NO: 249712 - protein, 21 aa, Homo sapiens
  Native (MAGC1_HUMAN)
KDMPTAGMPSLLQSSSESPQS

SEQ ID NO: 249713 - protein, 22 aa, Homo sapiens
  Native (MAGC1_HUMAN)
KDMPTAGMPSLLQSSSESPQSC

SEQ ID NO: 249714 - protein, 23 aa, Homo sapiens
  Native (MAGC1_HUMAN)
KDMPTAGMPSLLQSSSESPQSCP

SEQ ID NO: 249715 - protein, 24 aa, Homo sapiens
  Native (MAGC1_HUMAN)
KDMPTAGMPSLLQSSSESPQSCPE

SEQ ID NO: 249716 - protein, 25 aa, Homo sapiens
  Native (MAGC1_HUMAN)
KDMPTAGMPSLLQSSSESPQSCPEG

SEQ ID NO: 249717 - protein, 15 aa, Homo sapiens
  Native (MAGC1_HUMAN)
KDSLSPLEISQSPPE

SEQ ID NO: 249718 - protein, 20 aa, Homo sapiens
  Native (MAGC1_HUMAN)
KDSLSPLEISQSPPEGEDVQ

SEQ ID NO: 249719 - protein, 19 aa, Homo sapiens
  Native (MAGC1_HUMAN)
KDVEERAQAIIDTTDDSTA

SEQ ID NO: 249720 - protein, 20 aa, Homo sapiens
  Native (MAGC1_HUMAN)
KDVEERAQAIIDTTDDSTAT

SEQ ID NO: 249721 - protein, 24 aa, Homo sapiens
  Native (MAGC1_HUMAN)
KDVEERAQAIIDTTDDSTATESAS

SEQ ID NO: 249722 - protein, 25 aa, Homo sapiens
  Native (MAGC1_HUMAN)
KDVEERAQAIIDTTDDSTATESASS

SEQ ID NO: 249723 - protein, 14 aa, Homo sapiens
  Native (MAGC1_HUMAN)
KGTYASEEVIWDVL

SEQ ID NO: 249724 - protein, 15 aa, Homo sapiens
  Native (MAGC1_HUMAN)
KGTYASEEVIWDVLS

SEQ ID NO: 249725 - protein, 16 aa, Homo sapiens
  Native (MAGC1_HUMAN)
KGTYASEEVIWDVLSG

SEQ ID NO: 249726 - protein, 17 aa, Homo sapiens
  Native (MAGC1_HUMAN)
KGTYASEEVIWDVLSGI

SEQ ID NO: 249727 - protein, 18 aa, Homo sapiens
  Native (MAGC1_HUMAN)
KGTYASEEVIWDVLSGIG

SEQ ID NO: 249728 - protein, 19 aa, Homo sapiens
  Native (MAGC1_HUMAN)
KGTYASEEVIWDVLSGIGV

SEQ ID NO: 249729 - protein, 20 aa, Homo sapiens
  Native (MAGC1_HUMAN)
KGTYASEEVIWDVLSGIGVR

SEQ ID NO: 249730 - protein, 21 aa, Homo sapiens
  Native (MAGC1_HUMAN)
KGTYASEEVIWDVLSGIGVRA

SEQ ID NO: 249731 - protein, 22 aa, Homo sapiens
  Native (MAGC1_HUMAN)
KGTYASEEVIWDVLSGIGVRAG

SEQ ID NO: 249732 - protein, 23 aa, Homo sapiens
  Native (MAGC1_HUMAN)
KGTYASEEVIWDVLSGIGVRAGR

SEQ ID NO: 249733 - protein, 24 aa, Homo sapiens
  Native (MAGC1_HUMAN)
KGTYASEEVIWDVLSGIGVRAGRE

SEQ ID NO: 249734 - protein, 25 aa, Homo sapiens
  Native (MAGC1_HUMAN)
KGTYASEEVIWDVLSGIGVRAGREH

SEQ ID NO: 249735 - protein, 14 aa, Homo sapiens
  Native (MAGC1_HUMAN)
KQPITKAEMLTNVI

SEQ ID NO: 249736 - protein, 15 aa, Homo sapiens
  Native (MAGC1_HUMAN)
KQPITKAEMLTNVIS

SEQ ID NO: 249737 - protein, 16 aa, Homo sapiens
  Native (MAGC1_HUMAN)
KQPITKAEMLTNVISR

SEQ ID NO: 249738 - protein, 17 aa, Homo sapiens
  Native (MAGC1_HUMAN)
KQPITKAEMLTNVISRY

SEQ ID NO: 249739 - protein, 18 aa, Homo sapiens
  Native (MAGC1_HUMAN)
KQPITKAEMLTNVISRYT

SEQ ID NO: 249740 - protein, 19 aa, Homo sapiens
  Native (MAGC1_HUMAN)
KQPITKAEMLTNVISRYTG

SEQ ID NO: 249741 - protein, 20 aa, Homo sapiens
  Native (MAGC1_HUMAN)
KQPITKAEMLTNVISRYTGY

SEQ ID NO: 249742 - protein, 21 aa, Homo sapiens
  Native (MAGC1_HUMAN)
KQPITKAEMLTNVISRYTGYF

SEQ ID NO: 249743 - protein, 22 aa, Homo sapiens
  Native (MAGC1_HUMAN)
KQPITKAEMLTNVISRYTGYFP

SEQ ID NO: 249744 - protein, 23 aa, Homo sapiens
  Native (MAGC1_HUMAN)
KQPITKAEMLTNVISRYTGYFPV

SEQ ID NO: 249745 - protein, 24 aa, Homo sapiens
  Native (MAGC1_HUMAN)
KQPITKAEMLTNVISRYTGYFPVI

SEQ ID NO: 249746 - protein, 25 aa, Homo sapiens
  Native (MAGC1_HUMAN)
KQPITKAEMLTNVISRYTGYFPVIF

SEQ ID NO: 249747 - protein, 13 aa, Homo sapiens
  Native (MAGC1_HUMAN)
KRKVVEFLAMLKN

SEQ ID NO: 249748 - protein, 14 aa, Homo sapiens
  Native (MAGC1_HUMAN)
KRKVVEFLAMLKNT

SEQ ID NO: 249749 - protein, 15 aa, Homo sapiens
  Native (MAGC1_HUMAN)
KRKVVEFLAMLKNTV

SEQ ID NO: 249750 - protein, 16 aa, Homo sapiens
  Native (MAGC1_HUMAN)
KRKVVEFLAMLKNTVP

SEQ ID NO: 249751 - protein, 17 aa, Homo sapiens
  Native (MAGC1_HUMAN)
KRKVVEFLAMLKNTVPI

SEQ ID NO: 249752 - protein, 18 aa, Homo sapiens
  Native (MAGC1_HUMAN)
KRKVVEFLAMLKNTVPIT

SEQ ID NO: 249753 - protein, 19 aa, Homo sapiens
  Native (MAGC1_HUMAN)
KRKVVEFLAMLKNTVPITF

SEQ ID NO: 249754 - protein, 20 aa, Homo sapiens
  Native (MAGC1_HUMAN)
KRKVVEFLAMLKNTVPITFP

SEQ ID NO: 249755 - protein, 21 aa, Homo sapiens
  Native (MAGC1_HUMAN)
KRKVVEFLAMLKNTVPITFPS

SEQ ID NO: 249756 - protein, 22 aa, Homo sapiens
  Native (MAGC1_HUMAN)
KRKVVEFLAMLKNTVPITFPSS

SEQ ID NO: 249757 - protein, 23 aa, Homo sapiens
  Native (MAGC1_HUMAN)
KRKVVEFLAMLKNTVPITFPSSY

SEQ ID NO: 249758 - protein, 24 aa, Homo sapiens
  Native (MAGC1_HUMAN)
KRKVVEFLAMLKNTVPITFPSSYK

SEQ ID NO: 249759 - protein, 25 aa, Homo sapiens
  Native (MAGC1_HUMAN)
KRKVVEFLAMLKNTVPITFPSSYKD

SEQ ID NO: 249760 - protein, 20 aa, Homo sapiens
  Native (MAGC1_HUMAN)
KSSPESPLQSPVISFSSSTS

SEQ ID NO: 249761 - protein, 21 aa, Homo sapiens
  Native (MAGC1_HUMAN)
KSSPESPLQSPVISFSSSTSL

SEQ ID NO: 249762 - protein, 22 aa, Homo sapiens
  Native (MAGC1_HUMAN)
KSSPESPLQSPVISFSSSTSLS

SEQ ID NO: 249763 - protein, 23 aa, Homo sapiens
  Native (MAGC1_HUMAN)
KSSPESPLQSPVISFSSSTSLSP

SEQ ID NO: 249764 - protein, 24 aa, Homo sapiens
  Native (MAGC1_HUMAN)
KSSPESPLQSPVISFSSSTSLSPF

SEQ ID NO: 249765 - protein, 25 aa, Homo sapiens
  Native (MAGC1_HUMAN)
KSSPESPLQSPVISFSSSTSLSPFS

SEQ ID NO: 249766 - protein, 13 aa, Homo sapiens
  Native (MAGC1_HUMAN)
KVDELARFLLLKY

SEQ ID NO: 249767 - protein, 14 aa, Homo sapiens
  Native (MAGC1_HUMAN)
KVDELARFLLLKYQ

SEQ ID NO: 249768 - protein, 15 aa, Homo sapiens
  Native (MAGC1_HUMAN)
KVDELARFLLLKYQV

SEQ ID NO: 249769 - protein, 16 aa, Homo sapiens
  Native (MAGC1_HUMAN)
KVDELARFLLLKYQVK

SEQ ID NO: 249770 - protein, 17 aa, Homo sapiens
  Native (MAGC1_HUMAN)
KVDELARFLLLKYQVKQ

SEQ ID NO: 249771 - protein, 18 aa, Homo sapiens
  Native (MAGC1_HUMAN)
KVDELARFLLLKYQVKQP

SEQ ID NO: 249772 - protein, 19 aa, Homo sapiens
  Native (MAGC1_HUMAN)
KVDELARFLLLKYQVKQPI

SEQ ID NO: 249773 - protein, 20 aa, Homo sapiens
  Native (MAGC1_HUMAN)
KVDELARFLLLKYQVKQPIT

SEQ ID NO: 249774 - protein, 21 aa, Homo sapiens
  Native (MAGC1_HUMAN)
KVDELARFLLLKYQVKQPITK

SEQ ID NO: 249775 - protein, 22 aa, Homo sapiens
  Native (MAGC1_HUMAN)
KVDELARFLLLKYQVKQPITKA

SEQ ID NO: 249776 - protein, 23 aa, Homo sapiens
  Native (MAGC1_HUMAN)
KVDELARFLLLKYQVKQPITKAE

SEQ ID NO: 249777 - protein, 24 aa, Homo sapiens
  Native (MAGC1_HUMAN)
KVDELARFLLLKYQVKQPITKAEM

SEQ ID NO: 249778 - protein, 25 aa, Homo sapiens
  Native (MAGC1_HUMAN)
KVDELARFLLLKYQVKQPITKAEML

SEQ ID NO: 249779 - protein, 13 aa, Homo sapiens
  Native (MAGC1_HUMAN)
KVVEFLAMLKNTV

SEQ ID NO: 249780 - protein, 14 aa, Homo sapiens
  Native (MAGC1_HUMAN)
KVVEFLAMLKNTVP

SEQ ID NO: 249781 - protein, 15 aa, Homo sapiens
  Native (MAGC1_HUMAN)
KVVEFLAMLKNTVPI

SEQ ID NO: 249782 - protein, 16 aa, Homo sapiens
  Native (MAGC1_HUMAN)
KVVEFLAMLKNTVPIT

SEQ ID NO: 249783 - protein, 17 aa, Homo sapiens
  Native (MAGC1_HUMAN)
KVVEFLAMLKNTVPITF

SEQ ID NO: 249784 - protein, 18 aa, Homo sapiens
  Native (MAGC1_HUMAN)
KVVEFLAMLKNTVPITFP

SEQ ID NO: 249785 - protein, 19 aa, Homo sapiens
  Native (MAGC1_HUMAN)
KVVEFLAMLKNTVPITFPS

SEQ ID NO: 249786 - protein, 20 aa, Homo sapiens
  Native (MAGC1_HUMAN)
KVVEFLAMLKNTVPITFPSS

SEQ ID NO: 249787 - protein, 21 aa, Homo sapiens
  Native (MAGC1_HUMAN)
KVVEFLAMLKNTVPITFPSSY

SEQ ID NO: 249788 - protein, 22 aa, Homo sapiens
  Native (MAGC1_HUMAN)
KVVEFLAMLKNTVPITFPSSYK

SEQ ID NO: 249789 - protein, 23 aa, Homo sapiens
  Native (MAGC1_HUMAN)
KVVEFLAMLKNTVPITFPSSYKD

SEQ ID NO: 249790 - protein, 24 aa, Homo sapiens
  Native (MAGC1_HUMAN)
KVVEFLAMLKNTVPITFPSSYKDA

SEQ ID NO: 249791 - protein, 25 aa, Homo sapiens
  Native (MAGC1_HUMAN)
KVVEFLAMLKNTVPITFPSSYKDAL

SEQ ID NO: 249792 - protein, 13 aa, Homo sapiens
  Native (MAGC1_HUMAN)
KVWVQEHYLEYRE

SEQ ID NO: 249793 - protein, 14 aa, Homo sapiens
  Native (MAGC1_HUMAN)
KVWVQEHYLEYREV

SEQ ID NO: 249794 - protein, 15 aa, Homo sapiens
  Native (MAGC1_HUMAN)
KVWVQEHYLEYREVP

SEQ ID NO: 249795 - protein, 16 aa, Homo sapiens
  Native (MAGC1_HUMAN)
KVWVQEHYLEYREVPN

SEQ ID NO: 249796 - protein, 17 aa, Homo sapiens
  Native (MAGC1_HUMAN)
KVWVQEHYLEYREVPNS

SEQ ID NO: 249797 - protein, 18 aa, Homo sapiens
  Native (MAGC1_HUMAN)
KVWVQEHYLEYREVPNSS

SEQ ID NO: 249798 - protein, 19 aa, Homo sapiens
  Native (MAGC1_HUMAN)
KVWVQEHYLEYREVPNSSP

SEQ ID NO: 249799 - protein, 20 aa, Homo sapiens
  Native (MAGC1_HUMAN)
KVWVQEHYLEYREVPNSSPP

SEQ ID NO: 249800 - protein, 21 aa, Homo sapiens
  Native (MAGC1_HUMAN)
KVWVQEHYLEYREVPNSSPPR

SEQ ID NO: 249801 - protein, 22 aa, Homo sapiens
  Native (MAGC1_HUMAN)
KVWVQEHYLEYREVPNSSPPRY

SEQ ID NO: 249802 - protein, 23 aa, Homo sapiens
  Native (MAGC1_HUMAN)
KVWVQEHYLEYREVPNSSPPRYE

SEQ ID NO: 249803 - protein, 24 aa, Homo sapiens
  Native (MAGC1_HUMAN)
KVWVQEHYLEYREVPNSSPPRYEF

SEQ ID NO: 249804 - protein, 25 aa, Homo sapiens
  Native (MAGC1_HUMAN)
KVWVQEHYLEYREVPNSSPPRYEFL

SEQ ID NO: 249805 - protein, 15 aa, Homo sapiens
  Native (MAGC1_HUMAN)
KYQVKQPITKAEMLT

SEQ ID NO: 249806 - protein, 17 aa, Homo sapiens
  Native (MAGC1_HUMAN)
KYQVKQPITKAEMLTNV

SEQ ID NO: 249807 - protein, 19 aa, Homo sapiens
  Native (MAGC1_HUMAN)
KYQVKQPITKAEMLTNVIS

SEQ ID NO: 249808 - protein, 20 aa, Homo sapiens
  Native (MAGC1_HUMAN)
KYQVKQPITKAEMLTNVISR

SEQ ID NO: 249809 - protein, 21 aa, Homo sapiens
  Native (MAGC1_HUMAN)
KYQVKQPITKAEMLTNVISRY

SEQ ID NO: 249810 - protein, 22 aa, Homo sapiens
  Native (MAGC1_HUMAN)
KYQVKQPITKAEMLTNVISRYT

SEQ ID NO: 249811 - protein, 23 aa, Homo sapiens
  Native (MAGC1_HUMAN)
KYQVKQPITKAEMLTNVISRYTG

SEQ ID NO: 249812 - protein, 24 aa, Homo sapiens
  Native (MAGC1_HUMAN)
KYQVKQPITKAEMLTNVISRYTGY

SEQ ID NO: 249813 - protein, 25 aa, Homo sapiens
  Native (MAGC1_HUMAN)
KYQVKQPITKAEMLTNVISRYTGYF

SEQ ID NO: 249814 - protein, 13 aa, Homo sapiens
  Native (MAGC1_HUMAN)
LAMLKNTVPITFP

SEQ ID NO: 249815 - protein, 14 aa, Homo sapiens
  Native (MAGC1_HUMAN)
LAMLKNTVPITFPS

SEQ ID NO: 249816 - protein, 15 aa, Homo sapiens
  Native (MAGC1_HUMAN)
LAMLKNTVPITFPSS

SEQ ID NO: 249817 - protein, 16 aa, Homo sapiens
  Native (MAGC1_HUMAN)
LAMLKNTVPITFPSSY

SEQ ID NO: 249818 - protein, 17 aa, Homo sapiens
  Native (MAGC1_HUMAN)
LAMLKNTVPITFPSSYK

SEQ ID NO: 249819 - protein, 18 aa, Homo sapiens
  Native (MAGC1_HUMAN)
LAMLKNTVPITFPSSYKD

SEQ ID NO: 249820 - protein, 19 aa, Homo sapiens
  Native (MAGC1_HUMAN)
LAMLKNTVPITFPSSYKDA

SEQ ID NO: 249821 - protein, 20 aa, Homo sapiens
  Native (MAGC1_HUMAN)
LAMLKNTVPITFPSSYKDAL

SEQ ID NO: 249822 - protein, 21 aa, Homo sapiens
  Native (MAGC1_HUMAN)
LAMLKNTVPITFPSSYKDALK

SEQ ID NO: 249823 - protein, 22 aa, Homo sapiens
  Native (MAGC1_HUMAN)
LAMLKNTVPITFPSSYKDALKD

SEQ ID NO: 249824 - protein, 23 aa, Homo sapiens
  Native (MAGC1_HUMAN)
LAMLKNTVPITFPSSYKDALKDV

SEQ ID NO: 249825 - protein, 24 aa, Homo sapiens
  Native (MAGC1_HUMAN)
LAMLKNTVPITFPSSYKDALKDVE

SEQ ID NO: 249826 - protein, 25 aa, Homo sapiens
  Native (MAGC1_HUMAN)
LAMLKNTVPITFPSSYKDALKDVEE

SEQ ID NO: 249827 - protein, 13 aa, Homo sapiens
  Native (MAGC1_HUMAN)
LARFLLLKYQVKQ

SEQ ID NO: 249828 - protein, 14 aa, Homo sapiens
  Native (MAGC1_HUMAN)
LARFLLLKYQVKQP

SEQ ID NO: 249829 - protein, 15 aa, Homo sapiens
  Native (MAGC1_HUMAN)
LARFLLLKYQVKQPI

SEQ ID NO: 249830 - protein, 16 aa, Homo sapiens
  Native (MAGC1_HUMAN)
LARFLLLKYQVKQPIT

SEQ ID NO: 249831 - protein, 17 aa, Homo sapiens
  Native (MAGC1_HUMAN)
LARFLLLKYQVKQPITK

SEQ ID NO: 249832 - protein, 18 aa, Homo sapiens
  Native (MAGC1_HUMAN)
LARFLLLKYQVKQPITKA

SEQ ID NO: 249833 - protein, 19 aa, Homo sapiens
  Native (MAGC1_HUMAN)
LARFLLLKYQVKQPITKAE

SEQ ID NO: 249834 - protein, 20 aa, Homo sapiens
  Native (MAGC1_HUMAN)
LARFLLLKYQVKQPITKAEM

SEQ ID NO: 249835 - protein, 21 aa, Homo sapiens
  Native (MAGC1_HUMAN)
LARFLLLKYQVKQPITKAEML

SEQ ID NO: 249836 - protein, 22 aa, Homo sapiens
  Native (MAGC1_HUMAN)
LARFLLLKYQVKQPITKAEMLT

SEQ ID NO: 249837 - protein, 23 aa, Homo sapiens
  Native (MAGC1_HUMAN)
LARFLLLKYQVKQPITKAEMLTN

SEQ ID NO: 249838 - protein, 24 aa, Homo sapiens
  Native (MAGC1_HUMAN)
LARFLLLKYQVKQPITKAEMLTNV

SEQ ID NO: 249839 - protein, 25 aa, Homo sapiens
  Native (MAGC1_HUMAN)
LARFLLLKYQVKQPITKAEMLTNVI

SEQ ID NO: 249840 - protein, 14 aa, Homo sapiens
  Native (MAGC1_HUMAN)
LDEKVDELARFLLL

SEQ ID NO: 249841 - protein, 15 aa, Homo sapiens
  Native (MAGC1_HUMAN)
LDEKVDELARFLLLK

SEQ ID NO: 249842 - protein, 16 aa, Homo sapiens
  Native (MAGC1_HUMAN)
LDEKVDELARFLLLKY

SEQ ID NO: 249843 - protein, 17 aa, Homo sapiens
  Native (MAGC1_HUMAN)
LDEKVDELARFLLLKYQ

SEQ ID NO: 249844 - protein, 18 aa, Homo sapiens
  Native (MAGC1_HUMAN)
LDEKVDELARFLLLKYQV

SEQ ID NO: 249845 - protein, 19 aa, Homo sapiens
  Native (MAGC1_HUMAN)
LDEKVDELARFLLLKYQVK

SEQ ID NO: 249846 - protein, 20 aa, Homo sapiens
  Native (MAGC1_HUMAN)
LDEKVDELARFLLLKYQVKQ

SEQ ID NO: 249847 - protein, 21 aa, Homo sapiens
  Native (MAGC1_HUMAN)
LDEKVDELARFLLLKYQVKQP

SEQ ID NO: 249848 - protein, 22 aa, Homo sapiens
  Native (MAGC1_HUMAN)
LDEKVDELARFLLLKYQVKQPI

SEQ ID NO: 249849 - protein, 23 aa, Homo sapiens
  Native (MAGC1_HUMAN)
LDEKVDELARFLLLKYQVKQPIT

SEQ ID NO: 249850 - protein, 24 aa, Homo sapiens
  Native (MAGC1_HUMAN)
LDEKVDELARFLLLKYQVKQPITK

SEQ ID NO: 249851 - protein, 25 aa, Homo sapiens
  Native (MAGC1_HUMAN)
LDEKVDELARFLLLKYQVKQPITKA

SEQ ID NO: 249852 - protein, 23 aa, Homo sapiens
  Native (MAGC1_HUMAN)
LDLTSEGCLSDEQGMSQNRLLIL

SEQ ID NO: 249853 - protein, 24 aa, Homo sapiens
  Native (MAGC1_HUMAN)
LDLTSEGCLSDEQGMSQNRLLILI

SEQ ID NO: 249854 - protein, 25 aa, Homo sapiens
  Native (MAGC1_HUMAN)
LDLTSEGCLSDEQGMSQNRLLILIL

SEQ ID NO: 249855 - protein, 15 aa, Homo sapiens
  Native (MAGC1_HUMAN)
LEGEDSLSSLHFPQS

SEQ ID NO: 249856 - protein, 16 aa, Homo sapiens
  Native (MAGC1_HUMAN)
LEGEDSLSSLHFPQSP

SEQ ID NO: 249857 - protein, 17 aa, Homo sapiens
  Native (MAGC1_HUMAN)
LEGEDSLSSLHFPQSPP

SEQ ID NO: 249858 - protein, 19 aa, Homo sapiens
  Native (MAGC1_HUMAN)
LEGEDSLSSLHFPQSPPEW

SEQ ID NO: 249859 - protein, 20 aa, Homo sapiens
  Native (MAGC1_HUMAN)
LEGEDSLSSLHFPQSPPEWE

SEQ ID NO: 249860 - protein, 21 aa, Homo sapiens
  Native (MAGC1_HUMAN)
LEGEDSLSSLHFPQSPPEWED

SEQ ID NO: 249861 - protein, 22 aa, Homo sapiens
  Native (MAGC1_HUMAN)
LEGEDSLSSLHFPQSPPEWEDS

SEQ ID NO: 249862 - protein, 23 aa, Homo sapiens
  Native (MAGC1_HUMAN)
LEGEDSLSSLHFPQSPPEWEDSL

SEQ ID NO: 249863 - protein, 24 aa, Homo sapiens
  Native (MAGC1_HUMAN)
LEGEDSLSSLHFPQSPPEWEDSLS

SEQ ID NO: 249864 - protein, 25 aa, Homo sapiens
  Native (MAGC1_HUMAN)
LEGEDSLSSLHFPQSPPEWEDSLSP

SEQ ID NO: 249865 - protein, 19 aa, Homo sapiens
  Native (MAGC1_HUMAN)
LESDSLTDSESLIESEPLF

SEQ ID NO: 249866 - protein, 20 aa, Homo sapiens
  Native (MAGC1_HUMAN)
LESDSLTDSESLIESEPLFT

SEQ ID NO: 249867 - protein, 21 aa, Homo sapiens
  Native (MAGC1_HUMAN)
LESDSLTDSESLIESEPLFTY

SEQ ID NO: 249868 - protein, 22 aa, Homo sapiens
  Native (MAGC1_HUMAN)
LESDSLTDSESLIESEPLFTYT

SEQ ID NO: 249869 - protein, 23 aa, Homo sapiens
  Native (MAGC1_HUMAN)
LESDSLTDSESLIESEPLFTYTL

SEQ ID NO: 249870 - protein, 24 aa, Homo sapiens
  Native (MAGC1_HUMAN)
LESDSLTDSESLIESEPLFTYTLD

SEQ ID NO: 249871 - protein, 25 aa, Homo sapiens
  Native (MAGC1_HUMAN)
LESDSLTDSESLIESEPLFTYTLDE

SEQ ID NO: 249872 - protein, 15 aa, Homo sapiens
  Native (MAGC1_HUMAN)
LEYREVPNSSPPRYE

SEQ ID NO: 249873 - protein, 22 aa, Homo sapiens
  Native (MAGC1_HUMAN)
LEYREVPNSSPPRYEFLWGPRA

SEQ ID NO: 249874 - protein, 23 aa, Homo sapiens
  Native (MAGC1_HUMAN)
LEYREVPNSSPPRYEFLWGPRAH

SEQ ID NO: 249875 - protein, 24 aa, Homo sapiens
  Native (MAGC1_HUMAN)
LEYREVPNSSPPRYEFLWGPRAHS

SEQ ID NO: 249876 - protein, 25 aa, Homo sapiens
  Native (MAGC1_HUMAN)
LEYREVPNSSPPRYEFLWGPRAHSE

SEQ ID NO: 249877 - protein, 14 aa, Homo sapiens
  Native (MAGC1_HUMAN)
LFGISLREVDPDDS

SEQ ID NO: 249878 - protein, 15 aa, Homo sapiens
  Native (MAGC1_HUMAN)
LFGISLREVDPDDSY

SEQ ID NO: 249879 - protein, 16 aa, Homo sapiens
  Native (MAGC1_HUMAN)
LFGISLREVDPDDSYV

SEQ ID NO: 249880 - protein, 20 aa, Homo sapiens
  Native (MAGC1_HUMAN)
LFGISLREVDPDDSYVFVNT

SEQ ID NO: 249881 - protein, 21 aa, Homo sapiens
  Native (MAGC1_HUMAN)
LFGISLREVDPDDSYVFVNTL

SEQ ID NO: 249882 - protein, 22 aa, Homo sapiens
  Native (MAGC1_HUMAN)
LFGISLREVDPDDSYVFVNTLD

SEQ ID NO: 249883 - protein, 23 aa, Homo sapiens
  Native (MAGC1_HUMAN)
LFGISLREVDPDDSYVFVNTLDL

SEQ ID NO: 249884 - protein, 24 aa, Homo sapiens
  Native (MAGC1_HUMAN)
LFGISLREVDPDDSYVFVNTLDLT

SEQ ID NO: 249885 - protein, 25 aa, Homo sapiens
  Native (MAGC1_HUMAN)
LFGISLREVDPDDSYVFVNTLDLTS

SEQ ID NO: 249886 - protein, 15 aa, Homo sapiens
  Native (MAGC1_HUMAN)
LFQSFSERTQSTFEG

SEQ ID NO: 249887 - protein, 16 aa, Homo sapiens
  Native (MAGC1_HUMAN)
LFQSFSERTQSTFEGF

SEQ ID NO: 249888 - protein, 17 aa, Homo sapiens
  Native (MAGC1_HUMAN)
LFQSFSERTQSTFEGFA

SEQ ID NO: 249889 - protein, 19 aa, Homo sapiens
  Native (MAGC1_HUMAN)
LFQSFSERTQSTFEGFAQS

SEQ ID NO: 249890 - protein, 20 aa, Homo sapiens
  Native (MAGC1_HUMAN)
LFQSFSERTQSTFEGFAQSS

SEQ ID NO: 249891 - protein, 21 aa, Homo sapiens
  Native (MAGC1_HUMAN)
LFQSFSERTQSTFEGFAQSSL

SEQ ID NO: 249892 - protein, 22 aa, Homo sapiens
  Native (MAGC1_HUMAN)
LFQSFSERTQSTFEGFAQSSLQ

SEQ ID NO: 249893 - protein, 23 aa, Homo sapiens
  Native (MAGC1_HUMAN)
LFQSFSERTQSTFEGFAQSSLQI

SEQ ID NO: 249894 - protein, 24 aa, Homo sapiens
  Native (MAGC1_HUMAN)
LFQSFSERTQSTFEGFAQSSLQIP

SEQ ID NO: 249895 - protein, 25 aa, Homo sapiens
  Native (MAGC1_HUMAN)
LFQSFSERTQSTFEGFAQSSLQIPV

SEQ ID NO: 249896 - protein, 20 aa, Homo sapiens
  Native (MAGC1_HUMAN)
LFQSSPECTQSTFEGFPQSP

SEQ ID NO: 249897 - protein, 21 aa, Homo sapiens
  Native (MAGC1_HUMAN)
LFQSSPECTQSTFEGFPQSPL

SEQ ID NO: 249898 - protein, 22 aa, Homo sapiens
  Native (MAGC1_HUMAN)
LFQSSPECTQSTFEGFPQSPLQ

SEQ ID NO: 249899 - protein, 23 aa, Homo sapiens
  Native (MAGC1_HUMAN)
LFQSSPECTQSTFEGFPQSPLQI

SEQ ID NO: 249900 - protein, 24 aa, Homo sapiens
  Native (MAGC1_HUMAN)
LFQSSPECTQSTFEGFPQSPLQIP

SEQ ID NO: 249901 - protein, 25 aa, Homo sapiens
  Native (MAGC1_HUMAN)
LFQSSPECTQSTFEGFPQSPLQIPQ

SEQ ID NO: 249902 - protein, 19 aa, Homo sapiens
  Native (MAGC1_HUMAN)
LFQSSPERTHSTFEGFPQS

SEQ ID NO: 249903 - protein, 20 aa, Homo sapiens
  Native (MAGC1_HUMAN)
LFQSSPERTHSTFEGFPQSL

SEQ ID NO: 249904 - protein, 21 aa, Homo sapiens
  Native (MAGC1_HUMAN)
LFQSSPERTHSTFEGFPQSLL

SEQ ID NO: 249905 - protein, 22 aa, Homo sapiens
  Native (MAGC1_HUMAN)
LFQSSPERTHSTFEGFPQSLLQ

SEQ ID NO: 249906 - protein, 23 aa, Homo sapiens
  Native (MAGC1_HUMAN)
LFQSSPERTHSTFEGFPQSLLQI

SEQ ID NO: 249907 - protein, 24 aa, Homo sapiens
  Native (MAGC1_HUMAN)
LFQSSPERTHSTFEGFPQSLLQIP

SEQ ID NO: 249908 - protein, 25 aa, Homo sapiens
  Native (MAGC1_HUMAN)
LFQSSPERTHSTFEGFPQSLLQIPM

SEQ ID NO: 249909 - protein, 20 aa, Homo sapiens
  Native (MAGC1_HUMAN)
LFQSSPERTHSTFEGFPQSP

SEQ ID NO: 249910 - protein, 21 aa, Homo sapiens
  Native (MAGC1_HUMAN)
LFQSSPERTHSTFEGFPQSPL

SEQ ID NO: 249911 - protein, 22 aa, Homo sapiens
  Native (MAGC1_HUMAN)
LFQSSPERTHSTFEGFPQSPLQ

SEQ ID NO: 249912 - protein, 23 aa, Homo sapiens
  Native (MAGC1_HUMAN)
LFQSSPERTHSTFEGFPQSPLQI

SEQ ID NO: 249913 - protein, 24 aa, Homo sapiens
  Native (MAGC1_HUMAN)
LFQSSPERTHSTFEGFPQSPLQIP

SEQ ID NO: 249914 - protein, 25 aa, Homo sapiens
  Native (MAGC1_HUMAN)
LFQSSPERTHSTFEGFPQSPLQIPM

SEQ ID NO: 249915 - protein, 25 aa, Homo sapiens
  Native (MAGC1_HUMAN)
LFQSSPERTHSTFEGFPQSPLQIPV

SEQ ID NO: 249916 - protein, 16 aa, Homo sapiens
  Native (MAGC1_HUMAN)
LFQSSPERTQSTFEGF

SEQ ID NO: 249917 - protein, 17 aa, Homo sapiens
  Native (MAGC1_HUMAN)
LFQSSPERTQSTFEGFP

SEQ ID NO: 249918 - protein, 19 aa, Homo sapiens
  Native (MAGC1_HUMAN)
LFQSSPERTQSTFEGFPQS

SEQ ID NO: 249919 - protein, 20 aa, Homo sapiens
  Native (MAGC1_HUMAN)
LFQSSPERTQSTFEGFPQSP

SEQ ID NO: 249920 - protein, 21 aa, Homo sapiens
  Native (MAGC1_HUMAN)
LFQSSPERTQSTFEGFPQSPL

SEQ ID NO: 249921 - protein, 22 aa, Homo sapiens
  Native (MAGC1_HUMAN)
LFQSSPERTQSTFEGFPQSPLQ

SEQ ID NO: 249922 - protein, 23 aa, Homo sapiens
  Native (MAGC1_HUMAN)
LFQSSPERTQSTFEGFPQSPLQI

SEQ ID NO: 249923 - protein, 24 aa, Homo sapiens
  Native (MAGC1_HUMAN)
LFQSSPERTQSTFEGFPQSPLQIP

SEQ ID NO: 249924 - protein, 25 aa, Homo sapiens
  Native (MAGC1_HUMAN)
LFQSSPERTQSTFEGFPQSPLQIPV

SEQ ID NO: 249925 - protein, 13 aa, Homo sapiens
  Native (MAGC1_HUMAN)
LFTYTLDEKVDEL

SEQ ID NO: 249926 - protein, 14 aa, Homo sapiens
  Native (MAGC1_HUMAN)
LFTYTLDEKVDELA

SEQ ID NO: 249927 - protein, 15 aa, Homo sapiens
  Native (MAGC1_HUMAN)
LFTYTLDEKVDELAR

SEQ ID NO: 249928 - protein, 16 aa, Homo sapiens
  Native (MAGC1_HUMAN)
LFTYTLDEKVDELARF

SEQ ID NO: 249929 - protein, 17 aa, Homo sapiens
  Native (MAGC1_HUMAN)
LFTYTLDEKVDELARFL

SEQ ID NO: 249930 - protein, 18 aa, Homo sapiens
  Native (MAGC1_HUMAN)
LFTYTLDEKVDELARFLL

SEQ ID NO: 249931 - protein, 19 aa, Homo sapiens
  Native (MAGC1_HUMAN)
LFTYTLDEKVDELARFLLL

SEQ ID NO: 249932 - protein, 20 aa, Homo sapiens
  Native (MAGC1_HUMAN)
LFTYTLDEKVDELARFLLLK

SEQ ID NO: 249933 - protein, 21 aa, Homo sapiens
  Native (MAGC1_HUMAN)
LFTYTLDEKVDELARFLLLKY

SEQ ID NO: 249934 - protein, 22 aa, Homo sapiens
  Native (MAGC1_HUMAN)
LFTYTLDEKVDELARFLLLKYQ

SEQ ID NO: 249935 - protein, 23 aa, Homo sapiens
  Native (MAGC1_HUMAN)
LFTYTLDEKVDELARFLLLKYQV

SEQ ID NO: 249936 - protein, 24 aa, Homo sapiens
  Native (MAGC1_HUMAN)
LFTYTLDEKVDELARFLLLKYQVK

SEQ ID NO: 249937 - protein, 25 aa, Homo sapiens
  Native (MAGC1_HUMAN)
LFTYTLDEKVDELARFLLLKYQVKQ

SEQ ID NO: 249938 - protein, 22 aa, Homo sapiens
  Native (MAGC1_HUMAN)
LHFPQFPPQGEDFQSSLQSPVS

SEQ ID NO: 249939 - protein, 23 aa, Homo sapiens
  Native (MAGC1_HUMAN)
LHFPQFPPQGEDFQSSLQSPVSI

SEQ ID NO: 249940 - protein, 24 aa, Homo sapiens
  Native (MAGC1_HUMAN)
LHFPQFPPQGEDFQSSLQSPVSIC

SEQ ID NO: 249941 - protein, 25 aa, Homo sapiens
  Native (MAGC1_HUMAN)
LHFPQFPPQGEDFQSSLQSPVSICS

SEQ ID NO: 249942 - protein, 24 aa, Homo sapiens
  Native (MAGC1_HUMAN)
LHFPQSPPEWEDSLSPLHFPQFPP

SEQ ID NO: 249943 - protein, 25 aa, Homo sapiens
  Native (MAGC1_HUMAN)
LHFPQSPPEWEDSLSPLHFPQFPPQ

SEQ ID NO: 249944 - protein, 14 aa, Homo sapiens
  Native (MAGC1_HUMAN)
LIESEPLFTYTLDE

SEQ ID NO: 249945 - protein, 15 aa, Homo sapiens
  Native (MAGC1_HUMAN)
LIESEPLFTYTLDEK

SEQ ID NO: 249946 - protein, 16 aa, Homo sapiens
  Native (MAGC1_HUMAN)
LIESEPLFTYTLDEKV

SEQ ID NO: 249947 - protein, 17 aa, Homo sapiens
  Native (MAGC1_HUMAN)
LIESEPLFTYTLDEKVD

SEQ ID NO: 249948 - protein, 18 aa, Homo sapiens
  Native (MAGC1_HUMAN)
LIESEPLFTYTLDEKVDE

SEQ ID NO: 249949 - protein, 19 aa, Homo sapiens
  Native (MAGC1_HUMAN)
LIESEPLFTYTLDEKVDEL

SEQ ID NO: 249950 - protein, 20 aa, Homo sapiens
  Native (MAGC1_HUMAN)
LIESEPLFTYTLDEKVDELA

SEQ ID NO: 249951 - protein, 21 aa, Homo sapiens
  Native (MAGC1_HUMAN)
LIESEPLFTYTLDEKVDELAR

SEQ ID NO: 249952 - protein, 22 aa, Homo sapiens
  Native (MAGC1_HUMAN)
LIESEPLFTYTLDEKVDELARF

SEQ ID NO: 249953 - protein, 23 aa, Homo sapiens
  Native (MAGC1_HUMAN)
LIESEPLFTYTLDEKVDELARFL

SEQ ID NO: 249954 - protein, 24 aa, Homo sapiens
  Native (MAGC1_HUMAN)
LIESEPLFTYTLDEKVDELARFLL

SEQ ID NO: 249955 - protein, 25 aa, Homo sapiens
  Native (MAGC1_HUMAN)
LIESEPLFTYTLDEKVDELARFLLL

SEQ ID NO: 249956 - protein, 14 aa, Homo sapiens
  Native (MAGC1_HUMAN)
LILILSIIFIKGTY

SEQ ID NO: 249957 - protein, 15 aa, Homo sapiens
  Native (MAGC1_HUMAN)
LILILSIIFIKGTYA

SEQ ID NO: 249958 - protein, 16 aa, Homo sapiens
  Native (MAGC1_HUMAN)
LILILSIIFIKGTYAS

SEQ ID NO: 249959 - protein, 17 aa, Homo sapiens
  Native (MAGC1_HUMAN)
LILILSIIFIKGTYASE

SEQ ID NO: 249960 - protein, 18 aa, Homo sapiens
  Native (MAGC1_HUMAN)
LILILSIIFIKGTYASEE

SEQ ID NO: 249961 - protein, 19 aa, Homo sapiens
  Native (MAGC1_HUMAN)
LILILSIIFIKGTYASEEV

SEQ ID NO: 249962 - protein, 20 aa, Homo sapiens
  Native (MAGC1_HUMAN)
LILILSIIFIKGTYASEEVI

SEQ ID NO: 249963 - protein, 21 aa, Homo sapiens
  Native (MAGC1_HUMAN)
LILILSIIFIKGTYASEEVIW

SEQ ID NO: 249964 - protein, 22 aa, Homo sapiens
  Native (MAGC1_HUMAN)
LILILSIIFIKGTYASEEVIWD

SEQ ID NO: 249965 - protein, 23 aa, Homo sapiens
  Native (MAGC1_HUMAN)
LILILSIIFIKGTYASEEVIWDV

SEQ ID NO: 249966 - protein, 24 aa, Homo sapiens
  Native (MAGC1_HUMAN)
LILILSIIFIKGTYASEEVIWDVL

SEQ ID NO: 249967 - protein, 25 aa, Homo sapiens
  Native (MAGC1_HUMAN)
LILILSIIFIKGTYASEEVIWDVLS

SEQ ID NO: 249968 - protein, 13 aa, Homo sapiens
  Native (MAGC1_HUMAN)
LILSIIFIKGTYA

SEQ ID NO: 249969 - protein, 14 aa, Homo sapiens
  Native (MAGC1_HUMAN)
LILSIIFIKGTYAS

SEQ ID NO: 249970 - protein, 15 aa, Homo sapiens
  Native (MAGC1_HUMAN)
LILSIIFIKGTYASE

SEQ ID NO: 249971 - protein, 16 aa, Homo sapiens
  Native (MAGC1_HUMAN)
LILSIIFIKGTYASEE

SEQ ID NO: 249972 - protein, 17 aa, Homo sapiens
  Native (MAGC1_HUMAN)
LILSIIFIKGTYASEEV

SEQ ID NO: 249973 - protein, 18 aa, Homo sapiens
  Native (MAGC1_HUMAN)
LILSIIFIKGTYASEEVI

SEQ ID NO: 249974 - protein, 19 aa, Homo sapiens
  Native (MAGC1_HUMAN)
LILSIIFIKGTYASEEVIW

SEQ ID NO: 249975 - protein, 20 aa, Homo sapiens
  Native (MAGC1_HUMAN)
LILSIIFIKGTYASEEVIWD

SEQ ID NO: 249976 - protein, 21 aa, Homo sapiens
  Native (MAGC1_HUMAN)
LILSIIFIKGTYASEEVIWDV

SEQ ID NO: 249977 - protein, 22 aa, Homo sapiens
  Native (MAGC1_HUMAN)
LILSIIFIKGTYASEEVIWDVL

SEQ ID NO: 249978 - protein, 23 aa, Homo sapiens
  Native (MAGC1_HUMAN)
LILSIIFIKGTYASEEVIWDVLS

SEQ ID NO: 249979 - protein, 24 aa, Homo sapiens
  Native (MAGC1_HUMAN)
LILSIIFIKGTYASEEVIWDVLSG

SEQ ID NO: 249980 - protein, 25 aa, Homo sapiens
  Native (MAGC1_HUMAN)
LILSIIFIKGTYASEEVIWDVLSGI

SEQ ID NO: 249981 - protein, 20 aa, Homo sapiens
  Native (MAGC1_HUMAN)
LKDVEERAQAIIDTTDDSTA

SEQ ID NO: 249982 - protein, 24 aa, Homo sapiens
  Native (MAGC1_HUMAN)
LKDVEERAQAIIDTTDDSTATESA

SEQ ID NO: 249983 - protein, 25 aa, Homo sapiens
  Native (MAGC1_HUMAN)
LKDVEERAQAIIDTTDDSTATESAS

SEQ ID NO: 249984 - protein, 15 aa, Homo sapiens
  Native (MAGC1_HUMAN)
LKNTVPITFPSSYKD

SEQ ID NO: 249985 - protein, 20 aa, Homo sapiens
  Native (MAGC1_HUMAN)
LKNTVPITFPSSYKDALKDV

SEQ ID NO: 249986 - protein, 14 aa, Homo sapiens
  Native (MAGC1_HUMAN)
LKYQVKQPITKAEM

SEQ ID NO: 249987 - protein, 15 aa, Homo sapiens
  Native (MAGC1_HUMAN)
LKYQVKQPITKAEML

SEQ ID NO: 249988 - protein, 16 aa, Homo sapiens
  Native (MAGC1_HUMAN)
LKYQVKQPITKAEMLT

SEQ ID NO: 249989 - protein, 17 aa, Homo sapiens
  Native (MAGC1_HUMAN)
LKYQVKQPITKAEMLTN

SEQ ID NO: 249990 - protein, 19 aa, Homo sapiens
  Native (MAGC1_HUMAN)
LKYQVKQPITKAEMLTNVI

SEQ ID NO: 249991 - protein, 20 aa, Homo sapiens
  Native (MAGC1_HUMAN)
LKYQVKQPITKAEMLTNVIS

SEQ ID NO: 249992 - protein, 21 aa, Homo sapiens
  Native (MAGC1_HUMAN)
LKYQVKQPITKAEMLTNVISR

SEQ ID NO: 249993 - protein, 22 aa, Homo sapiens
  Native (MAGC1_HUMAN)
LKYQVKQPITKAEMLTNVISRY

SEQ ID NO: 249994 - protein, 23 aa, Homo sapiens
  Native (MAGC1_HUMAN)
LKYQVKQPITKAEMLTNVISRYT

SEQ ID NO: 249995 - protein, 24 aa, Homo sapiens
  Native (MAGC1_HUMAN)
LKYQVKQPITKAEMLTNVISRYTG

SEQ ID NO: 249996 - protein, 25 aa, Homo sapiens
  Native (MAGC1_HUMAN)
LKYQVKQPITKAEMLTNVISRYTGY

SEQ ID NO: 249997 - protein, 20 aa, Homo sapiens
  Native (MAGC1_HUMAN)
LLESDSLTDSESLIESEPLF

SEQ ID NO: 249998 - protein, 21 aa, Homo sapiens
  Native (MAGC1_HUMAN)
LLESDSLTDSESLIESEPLFT

SEQ ID NO: 249999 - protein, 22 aa, Homo sapiens
  Native (MAGC1_HUMAN)
LLESDSLTDSESLIESEPLFTY

SEQ ID NO: 250000 - protein, 23 aa, Homo sapiens
  Native (MAGC1_HUMAN)
LLESDSLTDSESLIESEPLFTYT

SEQ ID NO: 250001 - protein, 24 aa, Homo sapiens
  Native (MAGC1_HUMAN)
LLESDSLTDSESLIESEPLFTYTL

SEQ ID NO: 250002 - protein, 25 aa, Homo sapiens
  Native (MAGC1_HUMAN)
LLESDSLTDSESLIESEPLFTYTLD

SEQ ID NO: 250003 - protein, 14 aa, Homo sapiens
  Native (MAGC1_HUMAN)
LLILILSIIFIKGT

SEQ ID NO: 250004 - protein, 15 aa, Homo sapiens
  Native (MAGC1_HUMAN)
LLILILSIIFIKGTY

SEQ ID NO: 250005 - protein, 16 aa, Homo sapiens
  Native (MAGC1_HUMAN)
LLILILSIIFIKGTYA

SEQ ID NO: 250006 - protein, 17 aa, Homo sapiens
  Native (MAGC1_HUMAN)
LLILILSIIFIKGTYAS

SEQ ID NO: 250007 - protein, 18 aa, Homo sapiens
  Native (MAGC1_HUMAN)
LLILILSIIFIKGTYASE

SEQ ID NO: 250008 - protein, 19 aa, Homo sapiens
  Native (MAGC1_HUMAN)
LLILILSIIFIKGTYASEE

SEQ ID NO: 250009 - protein, 20 aa, Homo sapiens
  Native (MAGC1_HUMAN)
LLILILSIIFIKGTYASEEV

SEQ ID NO: 250010 - protein, 21 aa, Homo sapiens
  Native (MAGC1_HUMAN)
LLILILSIIFIKGTYASEEVI

SEQ ID NO: 250011 - protein, 22 aa, Homo sapiens
  Native (MAGC1_HUMAN)
LLILILSIIFIKGTYASEEVIW

SEQ ID NO: 250012 - protein, 23 aa, Homo sapiens
  Native (MAGC1_HUMAN)
LLILILSIIFIKGTYASEEVIWD

SEQ ID NO: 250013 - protein, 24 aa, Homo sapiens
  Native (MAGC1_HUMAN)
LLILILSIIFIKGTYASEEVIWDV

SEQ ID NO: 250014 - protein, 25 aa, Homo sapiens
  Native (MAGC1_HUMAN)
LLILILSIIFIKGTYASEEVIWDVL

SEQ ID NO: 250015 - protein, 13 aa, Homo sapiens
  Native (MAGC1_HUMAN)
LLKYQVKQPITKA

SEQ ID NO: 250016 - protein, 14 aa, Homo sapiens
  Native (MAGC1_HUMAN)
LLKYQVKQPITKAE

SEQ ID NO: 250017 - protein, 15 aa, Homo sapiens
  Native (MAGC1_HUMAN)
LLKYQVKQPITKAEM

SEQ ID NO: 250018 - protein, 16 aa, Homo sapiens
  Native (MAGC1_HUMAN)
LLKYQVKQPITKAEML

SEQ ID NO: 250019 - protein, 17 aa, Homo sapiens
  Native (MAGC1_HUMAN)
LLKYQVKQPITKAEMLT

SEQ ID NO: 250020 - protein, 18 aa, Homo sapiens
  Native (MAGC1_HUMAN)
LLKYQVKQPITKAEMLTN

SEQ ID NO: 250021 - protein, 19 aa, Homo sapiens
  Native (MAGC1_HUMAN)
LLKYQVKQPITKAEMLTNV

SEQ ID NO: 250022 - protein, 20 aa, Homo sapiens
  Native (MAGC1_HUMAN)
LLKYQVKQPITKAEMLTNVI

SEQ ID NO: 250023 - protein, 21 aa, Homo sapiens
  Native (MAGC1_HUMAN)
LLKYQVKQPITKAEMLTNVIS

SEQ ID NO: 250024 - protein, 22 aa, Homo sapiens
  Native (MAGC1_HUMAN)
LLKYQVKQPITKAEMLTNVISR

SEQ ID NO: 250025 - protein, 23 aa, Homo sapiens
  Native (MAGC1_HUMAN)
LLKYQVKQPITKAEMLTNVISRY

SEQ ID NO: 250026 - protein, 24 aa, Homo sapiens
  Native (MAGC1_HUMAN)
LLKYQVKQPITKAEMLTNVISRYT

SEQ ID NO: 250027 - protein, 25 aa, Homo sapiens
  Native (MAGC1_HUMAN)
LLKYQVKQPITKAEMLTNVISRYTG

SEQ ID NO: 250028 - protein, 13 aa, Homo sapiens
  Native (MAGC1_HUMAN)
LLLKYQVKQPITK

SEQ ID NO: 250029 - protein, 14 aa, Homo sapiens
  Native (MAGC1_HUMAN)
LLLKYQVKQPITKA

SEQ ID NO: 250030 - protein, 16 aa, Homo sapiens
  Native (MAGC1_HUMAN)
LLLKYQVKQPITKAEM

SEQ ID NO: 250031 - protein, 17 aa, Homo sapiens
  Native (MAGC1_HUMAN)
LLLKYQVKQPITKAEML

SEQ ID NO: 250032 - protein, 18 aa, Homo sapiens
  Native (MAGC1_HUMAN)
LLLKYQVKQPITKAEMLT

SEQ ID NO: 250033 - protein, 19 aa, Homo sapiens
  Native (MAGC1_HUMAN)
LLLKYQVKQPITKAEMLTN

SEQ ID NO: 250034 - protein, 20 aa, Homo sapiens
  Native (MAGC1_HUMAN)
LLLKYQVKQPITKAEMLTNV

SEQ ID NO: 250035 - protein, 21 aa, Homo sapiens
  Native (MAGC1_HUMAN)
LLLKYQVKQPITKAEMLTNVI

SEQ ID NO: 250036 - protein, 22 aa, Homo sapiens
  Native (MAGC1_HUMAN)
LLLKYQVKQPITKAEMLTNVIS

SEQ ID NO: 250037 - protein, 23 aa, Homo sapiens
  Native (MAGC1_HUMAN)
LLLKYQVKQPITKAEMLTNVISR

SEQ ID NO: 250038 - protein, 24 aa, Homo sapiens
  Native (MAGC1_HUMAN)
LLLKYQVKQPITKAEMLTNVISRY

SEQ ID NO: 250039 - protein, 25 aa, Homo sapiens
  Native (MAGC1_HUMAN)
LLLKYQVKQPITKAEMLTNVISRYT

SEQ ID NO: 250040 - protein, 14 aa, Homo sapiens
  Native (MAGC1_HUMAN)
LLQIPMTSSFSSTL

SEQ ID NO: 250041 - protein, 15 aa, Homo sapiens
  Native (MAGC1_HUMAN)
LLQIPMTSSFSSTLL

SEQ ID NO: 250042 - protein, 16 aa, Homo sapiens
  Native (MAGC1_HUMAN)
LLQIPMTSSFSSTLLS

SEQ ID NO: 250043 - protein, 17 aa, Homo sapiens
  Native (MAGC1_HUMAN)
LLQIPMTSSFSSTLLSI

SEQ ID NO: 250044 - protein, 18 aa, Homo sapiens
  Native (MAGC1_HUMAN)
LLQIPMTSSFSSTLLSIF

SEQ ID NO: 250045 - protein, 19 aa, Homo sapiens
  Native (MAGC1_HUMAN)
LLQIPMTSSFSSTLLSIFQ

SEQ ID NO: 250046 - protein, 20 aa, Homo sapiens
  Native (MAGC1_HUMAN)
LLQIPMTSSFSSTLLSIFQS

SEQ ID NO: 250047 - protein, 21 aa, Homo sapiens
  Native (MAGC1_HUMAN)
LLQIPMTSSFSSTLLSIFQSS

SEQ ID NO: 250048 - protein, 22 aa, Homo sapiens
  Native (MAGC1_HUMAN)
LLQIPMTSSFSSTLLSIFQSSP

SEQ ID NO: 250049 - protein, 23 aa, Homo sapiens
  Native (MAGC1_HUMAN)
LLQIPMTSSFSSTLLSIFQSSPE

SEQ ID NO: 250050 - protein, 24 aa, Homo sapiens
  Native (MAGC1_HUMAN)
LLQIPMTSSFSSTLLSIFQSSPES

SEQ ID NO: 250051 - protein, 25 aa, Homo sapiens
  Native (MAGC1_HUMAN)
LLQIPMTSSFSSTLLSIFQSSPESA

SEQ ID NO: 250052 - protein, 14 aa, Homo sapiens
  Native (MAGC1_HUMAN)
LLSIFQSSPERTQS

SEQ ID NO: 250053 - protein, 15 aa, Homo sapiens
  Native (MAGC1_HUMAN)
LLSIFQSSPERTQST

SEQ ID NO: 250054 - protein, 16 aa, Homo sapiens
  Native (MAGC1_HUMAN)
LLSIFQSSPERTQSTF

SEQ ID NO: 250055 - protein, 17 aa, Homo sapiens
  Native (MAGC1_HUMAN)
LLSIFQSSPERTQSTFE

SEQ ID NO: 250056 - protein, 19 aa, Homo sapiens
  Native (MAGC1_HUMAN)
LLSIFQSSPERTQSTFEGF

SEQ ID NO: 250057 - protein, 20 aa, Homo sapiens
  Native (MAGC1_HUMAN)
LLSIFQSSPERTQSTFEGFA

SEQ ID NO: 250058 - protein, 21 aa, Homo sapiens
  Native (MAGC1_HUMAN)
LLSIFQSSPERTQSTFEGFAQ

SEQ ID NO: 250059 - protein, 22 aa, Homo sapiens
  Native (MAGC1_HUMAN)
LLSIFQSSPERTQSTFEGFAQS

SEQ ID NO: 250060 - protein, 23 aa, Homo sapiens
  Native (MAGC1_HUMAN)
LLSIFQSSPERTQSTFEGFAQSP

SEQ ID NO: 250061 - protein, 24 aa, Homo sapiens
  Native (MAGC1_HUMAN)
LLSIFQSSPERTQSTFEGFAQSPL

SEQ ID NO: 250062 - protein, 25 aa, Homo sapiens
  Native (MAGC1_HUMAN)
LLSIFQSSPERTQSTFEGFAQSPLQ

SEQ ID NO: 250063 - protein, 13 aa, Homo sapiens
  Native (MAGC1_HUMAN)
LLSIFQSSPESAQ

SEQ ID NO: 250064 - protein, 14 aa, Homo sapiens
  Native (MAGC1_HUMAN)
LLSIFQSSPESAQS

SEQ ID NO: 250065 - protein, 15 aa, Homo sapiens
  Native (MAGC1_HUMAN)
LLSIFQSSPESAQST

SEQ ID NO: 250066 - protein, 16 aa, Homo sapiens
  Native (MAGC1_HUMAN)
LLSIFQSSPESAQSTF

SEQ ID NO: 250067 - protein, 17 aa, Homo sapiens
  Native (MAGC1_HUMAN)
LLSIFQSSPESAQSTFE

SEQ ID NO: 250068 - protein, 18 aa, Homo sapiens
  Native (MAGC1_HUMAN)
LLSIFQSSPESAQSTFEG

SEQ ID NO: 250069 - protein, 19 aa, Homo sapiens
  Native (MAGC1_HUMAN)
LLSIFQSSPESAQSTFEGF

SEQ ID NO: 250070 - protein, 20 aa, Homo sapiens
  Native (MAGC1_HUMAN)
LLSIFQSSPESAQSTFEGFP

SEQ ID NO: 250071 - protein, 21 aa, Homo sapiens
  Native (MAGC1_HUMAN)
LLSIFQSSPESAQSTFEGFPQ

SEQ ID NO: 250072 - protein, 22 aa, Homo sapiens
  Native (MAGC1_HUMAN)
LLSIFQSSPESAQSTFEGFPQS

SEQ ID NO: 250073 - protein, 23 aa, Homo sapiens
  Native (MAGC1_HUMAN)
LLSIFQSSPESAQSTFEGFPQSP

SEQ ID NO: 250074 - protein, 24 aa, Homo sapiens
  Native (MAGC1_HUMAN)
LLSIFQSSPESAQSTFEGFPQSPL

SEQ ID NO: 250075 - protein, 25 aa, Homo sapiens
  Native (MAGC1_HUMAN)
LLSIFQSSPESAQSTFEGFPQSPLQ

SEQ ID NO: 250076 - protein, 14 aa, Homo sapiens
  Native (MAGC1_HUMAN)
LLSIFQSSPESTQS

SEQ ID NO: 250077 - protein, 15 aa, Homo sapiens
  Native (MAGC1_HUMAN)
LLSIFQSSPESTQSP

SEQ ID NO: 250078 - protein, 16 aa, Homo sapiens
  Native (MAGC1_HUMAN)
LLSIFQSSPESTQSPF

SEQ ID NO: 250079 - protein, 17 aa, Homo sapiens
  Native (MAGC1_HUMAN)
LLSIFQSSPESTQSPFE

SEQ ID NO: 250080 - protein, 19 aa, Homo sapiens
  Native (MAGC1_HUMAN)
LLSIFQSSPESTQSPFEGF

SEQ ID NO: 250081 - protein, 20 aa, Homo sapiens
  Native (MAGC1_HUMAN)
LLSIFQSSPESTQSPFEGFP

SEQ ID NO: 250082 - protein, 24 aa, Homo sapiens
  Native (MAGC1_HUMAN)
LLSIFQSSPESTQSPFEGFPQSVL

SEQ ID NO: 250083 - protein, 25 aa, Homo sapiens
  Native (MAGC1_HUMAN)
LLSIFQSSPESTQSPFEGFPQSVLQ

SEQ ID NO: 250084 - protein, 14 aa, Homo sapiens
  Native (MAGC1_HUMAN)
LLSILQSSPESAQS

SEQ ID NO: 250085 - protein, 15 aa, Homo sapiens
  Native (MAGC1_HUMAN)
LLSILQSSPESAQSA

SEQ ID NO: 250086 - protein, 16 aa, Homo sapiens
  Native (MAGC1_HUMAN)
LLSILQSSPESAQSAF

SEQ ID NO: 250087 - protein, 17 aa, Homo sapiens
  Native (MAGC1_HUMAN)
LLSILQSSPESAQSAFE

SEQ ID NO: 250088 - protein, 18 aa, Homo sapiens
  Native (MAGC1_HUMAN)
LLSILQSSPESAQSAFEG

SEQ ID NO: 250089 - protein, 19 aa, Homo sapiens
  Native (MAGC1_HUMAN)
LLSILQSSPESAQSAFEGF

SEQ ID NO: 250090 - protein, 20 aa, Homo sapiens
  Native (MAGC1_HUMAN)
LLSILQSSPESAQSAFEGFP

SEQ ID NO: 250091 - protein, 21 aa, Homo sapiens
  Native (MAGC1_HUMAN)
LLSILQSSPESAQSAFEGFPQ

SEQ ID NO: 250092 - protein, 22 aa, Homo sapiens
  Native (MAGC1_HUMAN)
LLSILQSSPESAQSAFEGFPQS

SEQ ID NO: 250093 - protein, 23 aa, Homo sapiens
  Native (MAGC1_HUMAN)
LLSILQSSPESAQSAFEGFPQSP

SEQ ID NO: 250094 - protein, 24 aa, Homo sapiens
  Native (MAGC1_HUMAN)
LLSILQSSPESAQSAFEGFPQSPL

SEQ ID NO: 250095 - protein, 25 aa, Homo sapiens
  Native (MAGC1_HUMAN)
LLSILQSSPESAQSAFEGFPQSPLQ

SEQ ID NO: 250096 - protein, 13 aa, Homo sapiens
  Native (MAGC1_HUMAN)
LLSLFQSFSERTQ

SEQ ID NO: 250097 - protein, 14 aa, Homo sapiens
  Native (MAGC1_HUMAN)
LLSLFQSFSERTQS

SEQ ID NO: 250098 - protein, 15 aa, Homo sapiens
  Native (MAGC1_HUMAN)
LLSLFQSFSERTQST

SEQ ID NO: 250099 - protein, 16 aa, Homo sapiens
  Native (MAGC1_HUMAN)
LLSLFQSFSERTQSTF

SEQ ID NO: 250100 - protein, 17 aa, Homo sapiens
  Native (MAGC1_HUMAN)
LLSLFQSFSERTQSTFE

SEQ ID NO: 250101 - protein, 18 aa, Homo sapiens
  Native (MAGC1_HUMAN)
LLSLFQSFSERTQSTFEG

SEQ ID NO: 250102 - protein, 19 aa, Homo sapiens
  Native (MAGC1_HUMAN)
LLSLFQSFSERTQSTFEGF

SEQ ID NO: 250103 - protein, 20 aa, Homo sapiens
  Native (MAGC1_HUMAN)
LLSLFQSFSERTQSTFEGFA

SEQ ID NO: 250104 - protein, 21 aa, Homo sapiens
  Native (MAGC1_HUMAN)
LLSLFQSFSERTQSTFEGFAQ

SEQ ID NO: 250105 - protein, 22 aa, Homo sapiens
  Native (MAGC1_HUMAN)
LLSLFQSFSERTQSTFEGFAQS

SEQ ID NO: 250106 - protein, 23 aa, Homo sapiens
  Native (MAGC1_HUMAN)
LLSLFQSFSERTQSTFEGFAQSS

SEQ ID NO: 250107 - protein, 24 aa, Homo sapiens
  Native (MAGC1_HUMAN)
LLSLFQSFSERTQSTFEGFAQSSL

SEQ ID NO: 250108 - protein, 25 aa, Homo sapiens
  Native (MAGC1_HUMAN)
LLSLFQSFSERTQSTFEGFAQSSLQ

SEQ ID NO: 250109 - protein, 14 aa, Homo sapiens
  Native (MAGC1_HUMAN)
LLSLFQSSPECTQS

SEQ ID NO: 250110 - protein, 15 aa, Homo sapiens
  Native (MAGC1_HUMAN)
LLSLFQSSPECTQST

SEQ ID NO: 250111 - protein, 16 aa, Homo sapiens
  Native (MAGC1_HUMAN)
LLSLFQSSPECTQSTF

SEQ ID NO: 250112 - protein, 17 aa, Homo sapiens
  Native (MAGC1_HUMAN)
LLSLFQSSPECTQSTFE

SEQ ID NO: 250113 - protein, 19 aa, Homo sapiens
  Native (MAGC1_HUMAN)
LLSLFQSSPECTQSTFEGF

SEQ ID NO: 250114 - protein, 20 aa, Homo sapiens
  Native (MAGC1_HUMAN)
LLSLFQSSPECTQSTFEGFP

SEQ ID NO: 250115 - protein, 21 aa, Homo sapiens
  Native (MAGC1_HUMAN)
LLSLFQSSPECTQSTFEGFPQ

SEQ ID NO: 250116 - protein, 22 aa, Homo sapiens
  Native (MAGC1_HUMAN)
LLSLFQSSPECTQSTFEGFPQS

SEQ ID NO: 250117 - protein, 23 aa, Homo sapiens
  Native (MAGC1_HUMAN)
LLSLFQSSPECTQSTFEGFPQSP

SEQ ID NO: 250118 - protein, 24 aa, Homo sapiens
  Native (MAGC1_HUMAN)
LLSLFQSSPECTQSTFEGFPQSPL

SEQ ID NO: 250119 - protein, 25 aa, Homo sapiens
  Native (MAGC1_HUMAN)
LLSLFQSSPECTQSTFEGFPQSPLQ

SEQ ID NO: 250120 - protein, 13 aa, Homo sapiens
  Native (MAGC1_HUMAN)
LLSLFQSSPERTH

SEQ ID NO: 250121 - protein, 14 aa, Homo sapiens
  Native (MAGC1_HUMAN)
LLSLFQSSPERTHS

SEQ ID NO: 250122 - protein, 15 aa, Homo sapiens
  Native (MAGC1_HUMAN)
LLSLFQSSPERTHST

SEQ ID NO: 250123 - protein, 16 aa, Homo sapiens
  Native (MAGC1_HUMAN)
LLSLFQSSPERTHSTF

SEQ ID NO: 250124 - protein, 17 aa, Homo sapiens
  Native (MAGC1_HUMAN)
LLSLFQSSPERTHSTFE

SEQ ID NO: 250125 - protein, 18 aa, Homo sapiens
  Native (MAGC1_HUMAN)
LLSLFQSSPERTHSTFEG

SEQ ID NO: 250126 - protein, 19 aa, Homo sapiens
  Native (MAGC1_HUMAN)
LLSLFQSSPERTHSTFEGF

SEQ ID NO: 250127 - protein, 20 aa, Homo sapiens
  Native (MAGC1_HUMAN)
LLSLFQSSPERTHSTFEGFP

SEQ ID NO: 250128 - protein, 21 aa, Homo sapiens
  Native (MAGC1_HUMAN)
LLSLFQSSPERTHSTFEGFPQ

SEQ ID NO: 250129 - protein, 22 aa, Homo sapiens
  Native (MAGC1_HUMAN)
LLSLFQSSPERTHSTFEGFPQS

SEQ ID NO: 250130 - protein, 23 aa, Homo sapiens
  Native (MAGC1_HUMAN)
LLSLFQSSPERTHSTFEGFPQSL

SEQ ID NO: 250131 - protein, 24 aa, Homo sapiens
  Native (MAGC1_HUMAN)
LLSLFQSSPERTHSTFEGFPQSLL

SEQ ID NO: 250132 - protein, 25 aa, Homo sapiens
  Native (MAGC1_HUMAN)
LLSLFQSSPERTHSTFEGFPQSLLQ

SEQ ID NO: 250133 - protein, 23 aa, Homo sapiens
  Native (MAGC1_HUMAN)
LLSLFQSSPERTHSTFEGFPQSP

SEQ ID NO: 250134 - protein, 24 aa, Homo sapiens
  Native (MAGC1_HUMAN)
LLSLFQSSPERTHSTFEGFPQSPL

SEQ ID NO: 250135 - protein, 25 aa, Homo sapiens
  Native (MAGC1_HUMAN)
LLSLFQSSPERTHSTFEGFPQSPLQ

SEQ ID NO: 250136 - protein, 14 aa, Homo sapiens
  Native (MAGC1_HUMAN)
LLTKVWVQEHYLEY

SEQ ID NO: 250137 - protein, 15 aa, Homo sapiens
  Native (MAGC1_HUMAN)
LLTKVWVQEHYLEYR

SEQ ID NO: 250138 - protein, 16 aa, Homo sapiens
  Native (MAGC1_HUMAN)
LLTKVWVQEHYLEYRE

SEQ ID NO: 250139 - protein, 17 aa, Homo sapiens
  Native (MAGC1_HUMAN)
LLTKVWVQEHYLEYREV

SEQ ID NO: 250140 - protein, 18 aa, Homo sapiens
  Native (MAGC1_HUMAN)
LLTKVWVQEHYLEYREVP

SEQ ID NO: 250141 - protein, 19 aa, Homo sapiens
  Native (MAGC1_HUMAN)
LLTKVWVQEHYLEYREVPN

SEQ ID NO: 250142 - protein, 20 aa, Homo sapiens
  Native (MAGC1_HUMAN)
LLTKVWVQEHYLEYREVPNS

SEQ ID NO: 250143 - protein, 21 aa, Homo sapiens
  Native (MAGC1_HUMAN)
LLTKVWVQEHYLEYREVPNSS

SEQ ID NO: 250144 - protein, 22 aa, Homo sapiens
  Native (MAGC1_HUMAN)
LLTKVWVQEHYLEYREVPNSSP

SEQ ID NO: 250145 - protein, 23 aa, Homo sapiens
  Native (MAGC1_HUMAN)
LLTKVWVQEHYLEYREVPNSSPP

SEQ ID NO: 250146 - protein, 24 aa, Homo sapiens
  Native (MAGC1_HUMAN)
LLTKVWVQEHYLEYREVPNSSPPR

SEQ ID NO: 250147 - protein, 25 aa, Homo sapiens
  Native (MAGC1_HUMAN)
LLTKVWVQEHYLEYREVPNSSPPRY

SEQ ID NO: 250148 - protein, 14 aa, Homo sapiens
  Native (MAGC1_HUMAN)
LQGEEFQSSLQSPV

SEQ ID NO: 250149 - protein, 15 aa, Homo sapiens
  Native (MAGC1_HUMAN)
LQGEEFQSSLQSPVS

SEQ ID NO: 250150 - protein, 16 aa, Homo sapiens
  Native (MAGC1_HUMAN)
LQGEEFQSSLQSPVSI

SEQ ID NO: 250151 - protein, 17 aa, Homo sapiens
  Native (MAGC1_HUMAN)
LQGEEFQSSLQSPVSIC

SEQ ID NO: 250152 - protein, 18 aa, Homo sapiens
  Native (MAGC1_HUMAN)
LQGEEFQSSLQSPVSICS

SEQ ID NO: 250153 - protein, 19 aa, Homo sapiens
  Native (MAGC1_HUMAN)
LQGEEFQSSLQSPVSICSS

SEQ ID NO: 250154 - protein, 20 aa, Homo sapiens
  Native (MAGC1_HUMAN)
LQGEEFQSSLQSPVSICSSS

SEQ ID NO: 250155 - protein, 21 aa, Homo sapiens
  Native (MAGC1_HUMAN)
LQGEEFQSSLQSPVSICSSST

SEQ ID NO: 250156 - protein, 22 aa, Homo sapiens
  Native (MAGC1_HUMAN)
LQGEEFQSSLQSPVSICSSSTP

SEQ ID NO: 250157 - protein, 23 aa, Homo sapiens
  Native (MAGC1_HUMAN)
LQGEEFQSSLQSPVSICSSSTPS

SEQ ID NO: 250158 - protein, 24 aa, Homo sapiens
  Native (MAGC1_HUMAN)
LQGEEFQSSLQSPVSICSSSTPSS

SEQ ID NO: 250159 - protein, 25 aa, Homo sapiens
  Native (MAGC1_HUMAN)
LQGEEFQSSLQSPVSICSSSTPSSL

SEQ ID NO: 250160 - protein, 14 aa, Homo sapiens
  Native (MAGC1_HUMAN)
LQIPGSPSFSSTLL

SEQ ID NO: 250161 - protein, 15 aa, Homo sapiens
  Native (MAGC1_HUMAN)
LQIPGSPSFSSTLLS

SEQ ID NO: 250162 - protein, 16 aa, Homo sapiens
  Native (MAGC1_HUMAN)
LQIPGSPSFSSTLLSL

SEQ ID NO: 250163 - protein, 17 aa, Homo sapiens
  Native (MAGC1_HUMAN)
LQIPGSPSFSSTLLSLF

SEQ ID NO: 250164 - protein, 18 aa, Homo sapiens
  Native (MAGC1_HUMAN)
LQIPGSPSFSSTLLSLFQ

SEQ ID NO: 250165 - protein, 19 aa, Homo sapiens
  Native (MAGC1_HUMAN)
LQIPGSPSFSSTLLSLFQS

SEQ ID NO: 250166 - protein, 20 aa, Homo sapiens
  Native (MAGC1_HUMAN)
LQIPGSPSFSSTLLSLFQSS

SEQ ID NO: 250167 - protein, 21 aa, Homo sapiens
  Native (MAGC1_HUMAN)
LQIPGSPSFSSTLLSLFQSSP

SEQ ID NO: 250168 - protein, 22 aa, Homo sapiens
  Native (MAGC1_HUMAN)
LQIPGSPSFSSTLLSLFQSSPE

SEQ ID NO: 250169 - protein, 23 aa, Homo sapiens
  Native (MAGC1_HUMAN)
LQIPGSPSFSSTLLSLFQSSPER

SEQ ID NO: 250170 - protein, 24 aa, Homo sapiens
  Native (MAGC1_HUMAN)
LQIPGSPSFSSTLLSLFQSSPERT

SEQ ID NO: 250171 - protein, 25 aa, Homo sapiens
  Native (MAGC1_HUMAN)
LQIPGSPSFSSTLLSLFQSSPERTH

SEQ ID NO: 250172 - protein, 14 aa, Homo sapiens
  Native (MAGC1_HUMAN)
LQIPMTSSFSSTLL

SEQ ID NO: 250173 - protein, 15 aa, Homo sapiens
  Native (MAGC1_HUMAN)
LQIPMTSSFSSTLLS

SEQ ID NO: 250174 - protein, 16 aa, Homo sapiens
  Native (MAGC1_HUMAN)
LQIPMTSSFSSTLLSI

SEQ ID NO: 250175 - protein, 17 aa, Homo sapiens
  Native (MAGC1_HUMAN)
LQIPMTSSFSSTLLSIF

SEQ ID NO: 250176 - protein, 18 aa, Homo sapiens
  Native (MAGC1_HUMAN)
LQIPMTSSFSSTLLSIFQ

SEQ ID NO: 250177 - protein, 19 aa, Homo sapiens
  Native (MAGC1_HUMAN)
LQIPMTSSFSSTLLSIFQS

SEQ ID NO: 250178 - protein, 20 aa, Homo sapiens
  Native (MAGC1_HUMAN)
LQIPMTSSFSSTLLSIFQSS

SEQ ID NO: 250179 - protein, 21 aa, Homo sapiens
  Native (MAGC1_HUMAN)
LQIPMTSSFSSTLLSIFQSSP

SEQ ID NO: 250180 - protein, 22 aa, Homo sapiens
  Native (MAGC1_HUMAN)
LQIPMTSSFSSTLLSIFQSSPE

SEQ ID NO: 250181 - protein, 23 aa, Homo sapiens
  Native (MAGC1_HUMAN)
LQIPMTSSFSSTLLSIFQSSPES

SEQ ID NO: 250182 - protein, 24 aa, Homo sapiens
  Native (MAGC1_HUMAN)
LQIPMTSSFSSTLLSIFQSSPESA

SEQ ID NO: 250183 - protein, 25 aa, Homo sapiens
  Native (MAGC1_HUMAN)
LQIPMTSSFSSTLLSIFQSSPESAQ

SEQ ID NO: 250184 - protein, 17 aa, Homo sapiens
  Native (MAGC1_HUMAN)
LQIPMTSSFSSTLLSIL

SEQ ID NO: 250185 - protein, 18 aa, Homo sapiens
  Native (MAGC1_HUMAN)
LQIPMTSSFSSTLLSILQ

SEQ ID NO: 250186 - protein, 19 aa, Homo sapiens
  Native (MAGC1_HUMAN)
LQIPMTSSFSSTLLSILQS

SEQ ID NO: 250187 - protein, 20 aa, Homo sapiens
  Native (MAGC1_HUMAN)
LQIPMTSSFSSTLLSILQSS

SEQ ID NO: 250188 - protein, 21 aa, Homo sapiens
  Native (MAGC1_HUMAN)
LQIPMTSSFSSTLLSILQSSP

SEQ ID NO: 250189 - protein, 22 aa, Homo sapiens
  Native (MAGC1_HUMAN)
LQIPMTSSFSSTLLSILQSSPE

SEQ ID NO: 250190 - protein, 23 aa, Homo sapiens
  Native (MAGC1_HUMAN)
LQIPMTSSFSSTLLSILQSSPES

SEQ ID NO: 250191 - protein, 24 aa, Homo sapiens
  Native (MAGC1_HUMAN)
LQIPMTSSFSSTLLSILQSSPESA

SEQ ID NO: 250192 - protein, 25 aa, Homo sapiens
  Native (MAGC1_HUMAN)
LQIPMTSSFSSTLLSILQSSPESAQ

SEQ ID NO: 250193 - protein, 23 aa, Homo sapiens
  Native (MAGC1_HUMAN)
LQIPQSPLEGEDSLSSLHFPQSP

SEQ ID NO: 250194 - protein, 24 aa, Homo sapiens
  Native (MAGC1_HUMAN)
LQIPQSPLEGEDSLSSLHFPQSPP

SEQ ID NO: 250195 - protein, 25 aa, Homo sapiens
  Native (MAGC1_HUMAN)
LQIPQSPLEGEDSLSSLHFPQSPPE

SEQ ID NO: 250196 - protein, 23 aa, Homo sapiens
  Native (MAGC1_HUMAN)
LQIPQSPPEGENTHSPLQIVPSL

SEQ ID NO: 250197 - protein, 24 aa, Homo sapiens
  Native (MAGC1_HUMAN)
LQIPQSPPEGENTHSPLQIVPSLP

SEQ ID NO: 250198 - protein, 25 aa, Homo sapiens
  Native (MAGC1_HUMAN)
LQIPQSPPEGENTHSPLQIVPSLPE

SEQ ID NO: 250199 - protein, 23 aa, Homo sapiens
  Native (MAGC1_HUMAN)
LQIPQSSPESDDTLYPLQSPQSR

SEQ ID NO: 250200 - protein, 24 aa, Homo sapiens
  Native (MAGC1_HUMAN)
LQIPQSSPESDDTLYPLQSPQSRS

SEQ ID NO: 250201 - protein, 25 aa, Homo sapiens
  Native (MAGC1_HUMAN)
LQIPQSSPESDDTLYPLQSPQSRSE

SEQ ID NO: 250202 - protein, 13 aa, Homo sapiens
  Native (MAGC1_HUMAN)
LQIPVSAASSSTL

SEQ ID NO: 250203 - protein, 14 aa, Homo sapiens
  Native (MAGC1_HUMAN)
LQIPVSAASSSTLV

SEQ ID NO: 250204 - protein, 15 aa, Homo sapiens
  Native (MAGC1_HUMAN)
LQIPVSAASSSTLVS

SEQ ID NO: 250205 - protein, 16 aa, Homo sapiens
  Native (MAGC1_HUMAN)
LQIPVSAASSSTLVSI

SEQ ID NO: 250206 - protein, 17 aa, Homo sapiens
  Native (MAGC1_HUMAN)
LQIPVSAASSSTLVSIF

SEQ ID NO: 250207 - protein, 18 aa, Homo sapiens
  Native (MAGC1_HUMAN)
LQIPVSAASSSTLVSIFQ

SEQ ID NO: 250208 - protein, 19 aa, Homo sapiens
  Native (MAGC1_HUMAN)
LQIPVSAASSSTLVSIFQS

SEQ ID NO: 250209 - protein, 20 aa, Homo sapiens
  Native (MAGC1_HUMAN)
LQIPVSAASSSTLVSIFQSS

SEQ ID NO: 250210 - protein, 21 aa, Homo sapiens
  Native (MAGC1_HUMAN)
LQIPVSAASSSTLVSIFQSSP

SEQ ID NO: 250211 - protein, 22 aa, Homo sapiens
  Native (MAGC1_HUMAN)
LQIPVSAASSSTLVSIFQSSPE

SEQ ID NO: 250212 - protein, 23 aa, Homo sapiens
  Native (MAGC1_HUMAN)
LQIPVSAASSSTLVSIFQSSPES

SEQ ID NO: 250213 - protein, 24 aa, Homo sapiens
  Native (MAGC1_HUMAN)
LQIPVSAASSSTLVSIFQSSPEST

SEQ ID NO: 250214 - protein, 25 aa, Homo sapiens
  Native (MAGC1_HUMAN)
LQIPVSAASSSTLVSIFQSSPESTQ

SEQ ID NO: 250215 - protein, 14 aa, Homo sapiens
  Native (MAGC1_HUMAN)
LQIPVSPSFSSTLV

SEQ ID NO: 250216 - protein, 15 aa, Homo sapiens
  Native (MAGC1_HUMAN)
LQIPVSPSFSSTLVS

SEQ ID NO: 250217 - protein, 16 aa, Homo sapiens
  Native (MAGC1_HUMAN)
LQIPVSPSFSSTLVSL

SEQ ID NO: 250218 - protein, 17 aa, Homo sapiens
  Native (MAGC1_HUMAN)
LQIPVSPSFSSTLVSLF

SEQ ID NO: 250219 - protein, 18 aa, Homo sapiens
  Native (MAGC1_HUMAN)
LQIPVSPSFSSTLVSLFQ

SEQ ID NO: 250220 - protein, 19 aa, Homo sapiens
  Native (MAGC1_HUMAN)
LQIPVSPSFSSTLVSLFQS

SEQ ID NO: 250221 - protein, 20 aa, Homo sapiens
  Native (MAGC1_HUMAN)
LQIPVSPSFSSTLVSLFQSS

SEQ ID NO: 250222 - protein, 21 aa, Homo sapiens
  Native (MAGC1_HUMAN)
LQIPVSPSFSSTLVSLFQSSP

SEQ ID NO: 250223 - protein, 22 aa, Homo sapiens
  Native (MAGC1_HUMAN)
LQIPVSPSFSSTLVSLFQSSPE

SEQ ID NO: 250224 - protein, 23 aa, Homo sapiens
  Native (MAGC1_HUMAN)
LQIPVSPSFSSTLVSLFQSSPER

SEQ ID NO: 250225 - protein, 24 aa, Homo sapiens
  Native (MAGC1_HUMAN)
LQIPVSPSFSSTLVSLFQSSPERT

SEQ ID NO: 250226 - protein, 25 aa, Homo sapiens
  Native (MAGC1_HUMAN)
LQIPVSPSFSSTLVSLFQSSPERTQ

SEQ ID NO: 250227 - protein, 14 aa, Homo sapiens
  Native (MAGC1_HUMAN)
LQIPVSPSSSSTLL

SEQ ID NO: 250228 - protein, 15 aa, Homo sapiens
  Native (MAGC1_HUMAN)
LQIPVSPSSSSTLLS

SEQ ID NO: 250229 - protein, 16 aa, Homo sapiens
  Native (MAGC1_HUMAN)
LQIPVSPSSSSTLLSL

SEQ ID NO: 250230 - protein, 17 aa, Homo sapiens
  Native (MAGC1_HUMAN)
LQIPVSPSSSSTLLSLF

SEQ ID NO: 250231 - protein, 18 aa, Homo sapiens
  Native (MAGC1_HUMAN)
LQIPVSPSSSSTLLSLFQ

SEQ ID NO: 250232 - protein, 19 aa, Homo sapiens
  Native (MAGC1_HUMAN)
LQIPVSPSSSSTLLSLFQS

SEQ ID NO: 250233 - protein, 20 aa, Homo sapiens
  Native (MAGC1_HUMAN)
LQIPVSPSSSSTLLSLFQSF

SEQ ID NO: 250234 - protein, 21 aa, Homo sapiens
  Native (MAGC1_HUMAN)
LQIPVSPSSSSTLLSLFQSFS

SEQ ID NO: 250235 - protein, 22 aa, Homo sapiens
  Native (MAGC1_HUMAN)
LQIPVSPSSSSTLLSLFQSFSE

SEQ ID NO: 250236 - protein, 23 aa, Homo sapiens
  Native (MAGC1_HUMAN)
LQIPVSPSSSSTLLSLFQSFSER

SEQ ID NO: 250237 - protein, 24 aa, Homo sapiens
  Native (MAGC1_HUMAN)
LQIPVSPSSSSTLLSLFQSFSERT

SEQ ID NO: 250238 - protein, 25 aa, Homo sapiens
  Native (MAGC1_HUMAN)
LQIPVSPSSSSTLLSLFQSFSERTQ

SEQ ID NO: 250239 - protein, 14 aa, Homo sapiens
  Native (MAGC1_HUMAN)
LQIPVSRSFSSTLL

SEQ ID NO: 250240 - protein, 15 aa, Homo sapiens
  Native (MAGC1_HUMAN)
LQIPVSRSFSSTLLS

SEQ ID NO: 250241 - protein, 16 aa, Homo sapiens
  Native (MAGC1_HUMAN)
LQIPVSRSFSSTLLSI

SEQ ID NO: 250242 - protein, 17 aa, Homo sapiens
  Native (MAGC1_HUMAN)
LQIPVSRSFSSTLLSIF

SEQ ID NO: 250243 - protein, 18 aa, Homo sapiens
  Native (MAGC1_HUMAN)
LQIPVSRSFSSTLLSIFQ

SEQ ID NO: 250244 - protein, 19 aa, Homo sapiens
  Native (MAGC1_HUMAN)
LQIPVSRSFSSTLLSIFQS

SEQ ID NO: 250245 - protein, 20 aa, Homo sapiens
  Native (MAGC1_HUMAN)
LQIPVSRSFSSTLLSIFQSS

SEQ ID NO: 250246 - protein, 21 aa, Homo sapiens
  Native (MAGC1_HUMAN)
LQIPVSRSFSSTLLSIFQSSP

SEQ ID NO: 250247 - protein, 22 aa, Homo sapiens
  Native (MAGC1_HUMAN)
LQIPVSRSFSSTLLSIFQSSPE

SEQ ID NO: 250248 - protein, 23 aa, Homo sapiens
  Native (MAGC1_HUMAN)
LQIPVSRSFSSTLLSIFQSSPER

SEQ ID NO: 250249 - protein, 24 aa, Homo sapiens
  Native (MAGC1_HUMAN)
LQIPVSRSFSSTLLSIFQSSPERT

SEQ ID NO: 250250 - protein, 25 aa, Homo sapiens
  Native (MAGC1_HUMAN)
LQIPVSRSFSSTLLSIFQSSPERTQ

SEQ ID NO: 250251 - protein, 14 aa, Homo sapiens
  Native (MAGC1_HUMAN)
LQIPVSSSFSYTLL

SEQ ID NO: 250252 - protein, 15 aa, Homo sapiens
  Native (MAGC1_HUMAN)
LQIPVSSSFSYTLLS

SEQ ID NO: 250253 - protein, 16 aa, Homo sapiens
  Native (MAGC1_HUMAN)
LQIPVSSSFSYTLLSL

SEQ ID NO: 250254 - protein, 17 aa, Homo sapiens
  Native (MAGC1_HUMAN)
LQIPVSSSFSYTLLSLF

SEQ ID NO: 250255 - protein, 18 aa, Homo sapiens
  Native (MAGC1_HUMAN)
LQIPVSSSFSYTLLSLFQ

SEQ ID NO: 250256 - protein, 19 aa, Homo sapiens
  Native (MAGC1_HUMAN)
LQIPVSSSFSYTLLSLFQS

SEQ ID NO: 250257 - protein, 20 aa, Homo sapiens
  Native (MAGC1_HUMAN)
LQIPVSSSFSYTLLSLFQSS

SEQ ID NO: 250258 - protein, 21 aa, Homo sapiens
  Native (MAGC1_HUMAN)
LQIPVSSSFSYTLLSLFQSSP

SEQ ID NO: 250259 - protein, 22 aa, Homo sapiens
  Native (MAGC1_HUMAN)
LQIPVSSSFSYTLLSLFQSSPE

SEQ ID NO: 250260 - protein, 23 aa, Homo sapiens
  Native (MAGC1_HUMAN)
LQIPVSSSFSYTLLSLFQSSPER

SEQ ID NO: 250261 - protein, 24 aa, Homo sapiens
  Native (MAGC1_HUMAN)
LQIPVSSSFSYTLLSLFQSSPERT

SEQ ID NO: 250262 - protein, 25 aa, Homo sapiens
  Native (MAGC1_HUMAN)
LQIPVSSSFSYTLLSLFQSSPERTH

SEQ ID NO: 250263 - protein, 13 aa, Homo sapiens
  Native (MAGC1_HUMAN)
LQIPVSSSSSSST

SEQ ID NO: 250264 - protein, 14 aa, Homo sapiens
  Native (MAGC1_HUMAN)
LQIPVSSSSSSSTL

SEQ ID NO: 250265 - protein, 15 aa, Homo sapiens
  Native (MAGC1_HUMAN)
LQIPVSSSSSSSTLL

SEQ ID NO: 250266 - protein, 16 aa, Homo sapiens
  Native (MAGC1_HUMAN)
LQIPVSSSSSSSTLLS

SEQ ID NO: 250267 - protein, 17 aa, Homo sapiens
  Native (MAGC1_HUMAN)
LQIPVSSSSSSSTLLSL

SEQ ID NO: 250268 - protein, 18 aa, Homo sapiens
  Native (MAGC1_HUMAN)
LQIPVSSSSSSSTLLSLF

SEQ ID NO: 250269 - protein, 19 aa, Homo sapiens
  Native (MAGC1_HUMAN)
LQIPVSSSSSSSTLLSLFQ

SEQ ID NO: 250270 - protein, 20 aa, Homo sapiens
  Native (MAGC1_HUMAN)
LQIPVSSSSSSSTLLSLFQS

SEQ ID NO: 250271 - protein, 21 aa, Homo sapiens
  Native (MAGC1_HUMAN)
LQIPVSSSSSSSTLLSLFQSS

SEQ ID NO: 250272 - protein, 22 aa, Homo sapiens
  Native (MAGC1_HUMAN)
LQIPVSSSSSSSTLLSLFQSSP

SEQ ID NO: 250273 - protein, 23 aa, Homo sapiens
  Native (MAGC1_HUMAN)
LQIPVSSSSSSSTLLSLFQSSPE

SEQ ID NO: 250274 - protein, 24 aa, Homo sapiens
  Native (MAGC1_HUMAN)
LQIPVSSSSSSSTLLSLFQSSPEC

SEQ ID NO: 250275 - protein, 25 aa, Homo sapiens
  Native (MAGC1_HUMAN)
LQIPVSSSSSSSTLLSLFQSSPECT

SEQ ID NO: 250276 - protein, 13 aa, Homo sapiens
  Native (MAGC1_HUMAN)
LQIPVSSSSSSTL

SEQ ID NO: 250277 - protein, 14 aa, Homo sapiens
  Native (MAGC1_HUMAN)
LQIPVSSSSSSTLL

SEQ ID NO: 250278 - protein, 15 aa, Homo sapiens
  Native (MAGC1_HUMAN)
LQIPVSSSSSSTLLS

SEQ ID NO: 250279 - protein, 16 aa, Homo sapiens
  Native (MAGC1_HUMAN)
LQIPVSSSSSSTLLSL

SEQ ID NO: 250280 - protein, 17 aa, Homo sapiens
  Native (MAGC1_HUMAN)
LQIPVSSSSSSTLLSLF

SEQ ID NO: 250281 - protein, 18 aa, Homo sapiens
  Native (MAGC1_HUMAN)
LQIPVSSSSSSTLLSLFQ

SEQ ID NO: 250282 - protein, 19 aa, Homo sapiens
  Native (MAGC1_HUMAN)
LQIPVSSSSSSTLLSLFQS

SEQ ID NO: 250283 - protein, 20 aa, Homo sapiens
  Native (MAGC1_HUMAN)
LQIPVSSSSSSTLLSLFQSS

SEQ ID NO: 250284 - protein, 21 aa, Homo sapiens
  Native (MAGC1_HUMAN)
LQIPVSSSSSSTLLSLFQSSP

SEQ ID NO: 250285 - protein, 22 aa, Homo sapiens
  Native (MAGC1_HUMAN)
LQIPVSSSSSSTLLSLFQSSPE

SEQ ID NO: 250286 - protein, 23 aa, Homo sapiens
  Native (MAGC1_HUMAN)
LQIPVSSSSSSTLLSLFQSSPER

SEQ ID NO: 250287 - protein, 24 aa, Homo sapiens
  Native (MAGC1_HUMAN)
LQIPVSSSSSSTLLSLFQSSPERT

SEQ ID NO: 250288 - protein, 25 aa, Homo sapiens
  Native (MAGC1_HUMAN)
LQIPVSSSSSSTLLSLFQSSPERTH

SEQ ID NO: 250289 - protein, 14 aa, Homo sapiens
  Native (MAGC1_HUMAN)
LQIVPSLPEWEDSL

SEQ ID NO: 250290 - protein, 15 aa, Homo sapiens
  Native (MAGC1_HUMAN)
LQIVPSLPEWEDSLS

SEQ ID NO: 250291 - protein, 16 aa, Homo sapiens
  Native (MAGC1_HUMAN)
LQIVPSLPEWEDSLSP

SEQ ID NO: 250292 - protein, 17 aa, Homo sapiens
  Native (MAGC1_HUMAN)
LQIVPSLPEWEDSLSPH

SEQ ID NO: 250293 - protein, 19 aa, Homo sapiens
  Native (MAGC1_HUMAN)
LQIVPSLPEWEDSLSPHYF

SEQ ID NO: 250294 - protein, 20 aa, Homo sapiens
  Native (MAGC1_HUMAN)
LQIVPSLPEWEDSLSPHYFP

SEQ ID NO: 250295 - protein, 21 aa, Homo sapiens
  Native (MAGC1_HUMAN)
LQIVPSLPEWEDSLSPHYFPQ

SEQ ID NO: 250296 - protein, 22 aa, Homo sapiens
  Native (MAGC1_HUMAN)
LQIVPSLPEWEDSLSPHYFPQS

SEQ ID NO: 250297 - protein, 23 aa, Homo sapiens
  Native (MAGC1_HUMAN)
LQIVPSLPEWEDSLSPHYFPQSP

SEQ ID NO: 250298 - protein, 24 aa, Homo sapiens
  Native (MAGC1_HUMAN)
LQIVPSLPEWEDSLSPHYFPQSPP

SEQ ID NO: 250299 - protein, 25 aa, Homo sapiens
  Native (MAGC1_HUMAN)
LQIVPSLPEWEDSLSPHYFPQSPPQ

SEQ ID NO: 250300 - protein, 14 aa, Homo sapiens
  Native (MAGC1_HUMAN)
LQNPASSFFSSALL

SEQ ID NO: 250301 - protein, 15 aa, Homo sapiens
  Native (MAGC1_HUMAN)
LQNPASSFFSSALLS

SEQ ID NO: 250302 - protein, 16 aa, Homo sapiens
  Native (MAGC1_HUMAN)
LQNPASSFFSSALLSI

SEQ ID NO: 250303 - protein, 17 aa, Homo sapiens
  Native (MAGC1_HUMAN)
LQNPASSFFSSALLSIF

SEQ ID NO: 250304 - protein, 18 aa, Homo sapiens
  Native (MAGC1_HUMAN)
LQNPASSFFSSALLSIFQ

SEQ ID NO: 250305 - protein, 19 aa, Homo sapiens
  Native (MAGC1_HUMAN)
LQNPASSFFSSALLSIFQS

SEQ ID NO: 250306 - protein, 20 aa, Homo sapiens
  Native (MAGC1_HUMAN)
LQNPASSFFSSALLSIFQSS

SEQ ID NO: 250307 - protein, 21 aa, Homo sapiens
  Native (MAGC1_HUMAN)
LQNPASSFFSSALLSIFQSSP

SEQ ID NO: 250308 - protein, 22 aa, Homo sapiens
  Native (MAGC1_HUMAN)
LQNPASSFFSSALLSIFQSSPE

SEQ ID NO: 250309 - protein, 23 aa, Homo sapiens
  Native (MAGC1_HUMAN)
LQNPASSFFSSALLSIFQSSPES

SEQ ID NO: 250310 - protein, 24 aa, Homo sapiens
  Native (MAGC1_HUMAN)
LQNPASSFFSSALLSIFQSSPEST

SEQ ID NO: 250311 - protein, 25 aa, Homo sapiens
  Native (MAGC1_HUMAN)
LQNPASSFFSSALLSIFQSSPESTQ

SEQ ID NO: 250312 - protein, 13 aa, Homo sapiens
  Native (MAGC1_HUMAN)
LQRPVSSFFSYTL

SEQ ID NO: 250313 - protein, 14 aa, Homo sapiens
  Native (MAGC1_HUMAN)
LQRPVSSFFSYTLA

SEQ ID NO: 250314 - protein, 15 aa, Homo sapiens
  Native (MAGC1_HUMAN)
LQRPVSSFFSYTLAS

SEQ ID NO: 250315 - protein, 16 aa, Homo sapiens
  Native (MAGC1_HUMAN)
LQRPVSSFFSYTLASL

SEQ ID NO: 250316 - protein, 17 aa, Homo sapiens
  Native (MAGC1_HUMAN)
LQRPVSSFFSYTLASLL

SEQ ID NO: 250317 - protein, 18 aa, Homo sapiens
  Native (MAGC1_HUMAN)
LQRPVSSFFSYTLASLLQ

SEQ ID NO: 250318 - protein, 19 aa, Homo sapiens
  Native (MAGC1_HUMAN)
LQRPVSSFFSYTLASLLQS

SEQ ID NO: 250319 - protein, 20 aa, Homo sapiens
  Native (MAGC1_HUMAN)
LQRPVSSFFSYTLASLLQSS

SEQ ID NO: 250320 - protein, 21 aa, Homo sapiens
  Native (MAGC1_HUMAN)
LQRPVSSFFSYTLASLLQSSH

SEQ ID NO: 250321 - protein, 22 aa, Homo sapiens
  Native (MAGC1_HUMAN)
LQRPVSSFFSYTLASLLQSSHE

SEQ ID NO: 250322 - protein, 23 aa, Homo sapiens
  Native (MAGC1_HUMAN)
LQRPVSSFFSYTLASLLQSSHES

SEQ ID NO: 250323 - protein, 24 aa, Homo sapiens
  Native (MAGC1_HUMAN)
LQRPVSSFFSYTLASLLQSSHESP

SEQ ID NO: 250324 - protein, 25 aa, Homo sapiens
  Native (MAGC1_HUMAN)
LQRPVSSFFSYTLASLLQSSHESPQ

SEQ ID NO: 250325 - protein, 24 aa, Homo sapiens
  Native (MAGC1_HUMAN)
LQSPESAPEGEDSLSPLQIPQSPL

SEQ ID NO: 250326 - protein, 25 aa, Homo sapiens
  Native (MAGC1_HUMAN)
LQSPESAPEGEDSLSPLQIPQSPLE

SEQ ID NO: 250327 - protein, 14 aa, Homo sapiens
  Native (MAGC1_HUMAN)
LQSPVISFSSSTSL

SEQ ID NO: 250328 - protein, 15 aa, Homo sapiens
  Native (MAGC1_HUMAN)
LQSPVISFSSSTSLS

SEQ ID NO: 250329 - protein, 16 aa, Homo sapiens
  Native (MAGC1_HUMAN)
LQSPVISFSSSTSLSP

SEQ ID NO: 250330 - protein, 17 aa, Homo sapiens
  Native (MAGC1_HUMAN)
LQSPVISFSSSTSLSPF

SEQ ID NO: 250331 - protein, 18 aa, Homo sapiens
  Native (MAGC1_HUMAN)
LQSPVISFSSSTSLSPFS

SEQ ID NO: 250332 - protein, 19 aa, Homo sapiens
  Native (MAGC1_HUMAN)
LQSPVISFSSSTSLSPFSE

SEQ ID NO: 250333 - protein, 20 aa, Homo sapiens
  Native (MAGC1_HUMAN)
LQSPVISFSSSTSLSPFSEE

SEQ ID NO: 250334 - protein, 21 aa, Homo sapiens
  Native (MAGC1_HUMAN)
LQSPVISFSSSTSLSPFSEES

SEQ ID NO: 250335 - protein, 22 aa, Homo sapiens
  Native (MAGC1_HUMAN)
LQSPVISFSSSTSLSPFSEESS

SEQ ID NO: 250336 - protein, 23 aa, Homo sapiens
  Native (MAGC1_HUMAN)
LQSPVISFSSSTSLSPFSEESSS

SEQ ID NO: 250337 - protein, 24 aa, Homo sapiens
  Native (MAGC1_HUMAN)
LQSPVISFSSSTSLSPFSEESSSP

SEQ ID NO: 250338 - protein, 25 aa, Homo sapiens
  Native (MAGC1_HUMAN)
LQSPVISFSSSTSLSPFSEESSSPV

SEQ ID NO: 250339 - protein, 15 aa, Homo sapiens
  Native (MAGC1_HUMAN)
LQSPVSICSSSTPSS

SEQ ID NO: 250340 - protein, 16 aa, Homo sapiens
  Native (MAGC1_HUMAN)
LQSPVSICSSSTPSSL

SEQ ID NO: 250341 - protein, 17 aa, Homo sapiens
  Native (MAGC1_HUMAN)
LQSPVSICSSSTPSSLP

SEQ ID NO: 250342 - protein, 18 aa, Homo sapiens
  Native (MAGC1_HUMAN)
LQSPVSICSSSTPSSLPQ

SEQ ID NO: 250343 - protein, 19 aa, Homo sapiens
  Native (MAGC1_HUMAN)
LQSPVSICSSSTPSSLPQS

SEQ ID NO: 250344 - protein, 20 aa, Homo sapiens
  Native (MAGC1_HUMAN)
LQSPVSICSSSTPSSLPQSF

SEQ ID NO: 250345 - protein, 21 aa, Homo sapiens
  Native (MAGC1_HUMAN)
LQSPVSICSSSTPSSLPQSFP

SEQ ID NO: 250346 - protein, 22 aa, Homo sapiens
  Native (MAGC1_HUMAN)
LQSPVSICSSSTPSSLPQSFPE

SEQ ID NO: 250347 - protein, 23 aa, Homo sapiens
  Native (MAGC1_HUMAN)
LQSPVSICSSSTPSSLPQSFPES

SEQ ID NO: 250348 - protein, 24 aa, Homo sapiens
  Native (MAGC1_HUMAN)
LQSPVSICSSSTPSSLPQSFPESS

SEQ ID NO: 250349 - protein, 25 aa, Homo sapiens
  Native (MAGC1_HUMAN)
LQSPVSICSSSTPSSLPQSFPESSQ

SEQ ID NO: 250350 - protein, 14 aa, Homo sapiens
  Native (MAGC1_HUMAN)
LQSPVSICSSSTSL

SEQ ID NO: 250351 - protein, 15 aa, Homo sapiens
  Native (MAGC1_HUMAN)
LQSPVSICSSSTSLS

SEQ ID NO: 250352 - protein, 16 aa, Homo sapiens
  Native (MAGC1_HUMAN)
LQSPVSICSSSTSLSL

SEQ ID NO: 250353 - protein, 17 aa, Homo sapiens
  Native (MAGC1_HUMAN)
LQSPVSICSSSTSLSLP

SEQ ID NO: 250354 - protein, 18 aa, Homo sapiens
  Native (MAGC1_HUMAN)
LQSPVSICSSSTSLSLPQ

SEQ ID NO: 250355 - protein, 19 aa, Homo sapiens
  Native (MAGC1_HUMAN)
LQSPVSICSSSTSLSLPQS

SEQ ID NO: 250356 - protein, 20 aa, Homo sapiens
  Native (MAGC1_HUMAN)
LQSPVSICSSSTSLSLPQSF

SEQ ID NO: 250357 - protein, 21 aa, Homo sapiens
  Native (MAGC1_HUMAN)
LQSPVSICSSSTSLSLPQSFP

SEQ ID NO: 250358 - protein, 22 aa, Homo sapiens
  Native (MAGC1_HUMAN)
LQSPVSICSSSTSLSLPQSFPE

SEQ ID NO: 250359 - protein, 23 aa, Homo sapiens
  Native (MAGC1_HUMAN)
LQSPVSICSSSTSLSLPQSFPES

SEQ ID NO: 250360 - protein, 24 aa, Homo sapiens
  Native (MAGC1_HUMAN)
LQSPVSICSSSTSLSLPQSFPESP

SEQ ID NO: 250361 - protein, 25 aa, Homo sapiens
  Native (MAGC1_HUMAN)
LQSPVSICSSSTSLSLPQSFPESPQ

SEQ ID NO: 250362 - protein, 13 aa, Homo sapiens
  Native (MAGC1_HUMAN)
LQSPVSSFPSSTS

SEQ ID NO: 250363 - protein, 14 aa, Homo sapiens
  Native (MAGC1_HUMAN)
LQSPVSSFPSSTSS

SEQ ID NO: 250364 - protein, 15 aa, Homo sapiens
  Native (MAGC1_HUMAN)
LQSPVSSFPSSTSSS

SEQ ID NO: 250365 - protein, 16 aa, Homo sapiens
  Native (MAGC1_HUMAN)
LQSPVSSFPSSTSSSL

SEQ ID NO: 250366 - protein, 17 aa, Homo sapiens
  Native (MAGC1_HUMAN)
LQSPVSSFPSSTSSSLS

SEQ ID NO: 250367 - protein, 18 aa, Homo sapiens
  Native (MAGC1_HUMAN)
LQSPVSSFPSSTSSSLSQ

SEQ ID NO: 250368 - protein, 19 aa, Homo sapiens
  Native (MAGC1_HUMAN)
LQSPVSSFPSSTSSSLSQS

SEQ ID NO: 250369 - protein, 20 aa, Homo sapiens
  Native (MAGC1_HUMAN)
LQSPVSSFPSSTSSSLSQSS

SEQ ID NO: 250370 - protein, 21 aa, Homo sapiens
  Native (MAGC1_HUMAN)
LQSPVSSFPSSTSSSLSQSSP

SEQ ID NO: 250371 - protein, 22 aa, Homo sapiens
  Native (MAGC1_HUMAN)
LQSPVSSFPSSTSSSLSQSSPV

SEQ ID NO: 250372 - protein, 23 aa, Homo sapiens
  Native (MAGC1_HUMAN)
LQSPVSSFPSSTSSSLSQSSPVS

SEQ ID NO: 250373 - protein, 24 aa, Homo sapiens
  Native (MAGC1_HUMAN)
LQSPVSSFPSSTSSSLSQSSPVSS

SEQ ID NO: 250374 - protein, 25 aa, Homo sapiens
  Native (MAGC1_HUMAN)
LQSPVSSFPSSTSSSLSQSSPVSSF

SEQ ID NO: 250375 - protein, 15 aa, Homo sapiens
  Native (MAGC1_HUMAN)
LQSSPESAQSAFEGF

SEQ ID NO: 250376 - protein, 16 aa, Homo sapiens
  Native (MAGC1_HUMAN)
LQSSPESAQSAFEGFP

SEQ ID NO: 250377 - protein, 20 aa, Homo sapiens
  Native (MAGC1_HUMAN)
LQSSPESAQSAFEGFPQSPL

SEQ ID NO: 250378 - protein, 21 aa, Homo sapiens
  Native (MAGC1_HUMAN)
LQSSPESAQSAFEGFPQSPLQ

SEQ ID NO: 250379 - protein, 22 aa, Homo sapiens
  Native (MAGC1_HUMAN)
LQSSPESAQSAFEGFPQSPLQI

SEQ ID NO: 250380 - protein, 23 aa, Homo sapiens
  Native (MAGC1_HUMAN)
LQSSPESAQSAFEGFPQSPLQIP

SEQ ID NO: 250381 - protein, 24 aa, Homo sapiens
  Native (MAGC1_HUMAN)
LQSSPESAQSAFEGFPQSPLQIPV

SEQ ID NO: 250382 - protein, 25 aa, Homo sapiens
  Native (MAGC1_HUMAN)
LQSSPESAQSAFEGFPQSPLQIPVS

SEQ ID NO: 250383 - protein, 15 aa, Homo sapiens
  Native (MAGC1_HUMAN)
LREVDPDDSYVFVNT

SEQ ID NO: 250384 - protein, 19 aa, Homo sapiens
  Native (MAGC1_HUMAN)
LREVDPDDSYVFVNTLDLT

SEQ ID NO: 250385 - protein, 20 aa, Homo sapiens
  Native (MAGC1_HUMAN)
LREVDPDDSYVFVNTLDLTS

SEQ ID NO: 250386 - protein, 21 aa, Homo sapiens
  Native (MAGC1_HUMAN)
LREVDPDDSYVFVNTLDLTSE

SEQ ID NO: 250387 - protein, 22 aa, Homo sapiens
  Native (MAGC1_HUMAN)
LREVDPDDSYVFVNTLDLTSEG

SEQ ID NO: 250388 - protein, 23 aa, Homo sapiens
  Native (MAGC1_HUMAN)
LREVDPDDSYVFVNTLDLTSEGC

SEQ ID NO: 250389 - protein, 24 aa, Homo sapiens
  Native (MAGC1_HUMAN)
LREVDPDDSYVFVNTLDLTSEGCL

SEQ ID NO: 250390 - protein, 25 aa, Homo sapiens
  Native (MAGC1_HUMAN)
LREVDPDDSYVFVNTLDLTSEGCLS

SEQ ID NO: 250391 - protein, 15 aa, Homo sapiens
  Native (MAGC1_HUMAN)
LSDEQGMSQNRLLIL

SEQ ID NO: 250392 - protein, 16 aa, Homo sapiens
  Native (MAGC1_HUMAN)
LSDEQGMSQNRLLILI

SEQ ID NO: 250393 - protein, 17 aa, Homo sapiens
  Native (MAGC1_HUMAN)
LSDEQGMSQNRLLILIL

SEQ ID NO: 250394 - protein, 18 aa, Homo sapiens
  Native (MAGC1_HUMAN)
LSDEQGMSQNRLLILILS

SEQ ID NO: 250395 - protein, 19 aa, Homo sapiens
  Native (MAGC1_HUMAN)
LSDEQGMSQNRLLILILSI

SEQ ID NO: 250396 - protein, 20 aa, Homo sapiens
  Native (MAGC1_HUMAN)
LSDEQGMSQNRLLILILSII

SEQ ID NO: 250397 - protein, 21 aa, Homo sapiens
  Native (MAGC1_HUMAN)
LSDEQGMSQNRLLILILSIIF

SEQ ID NO: 250398 - protein, 22 aa, Homo sapiens
  Native (MAGC1_HUMAN)
LSDEQGMSQNRLLILILSIIFI

SEQ ID NO: 250399 - protein, 23 aa, Homo sapiens
  Native (MAGC1_HUMAN)
LSDEQGMSQNRLLILILSIIFIK

SEQ ID NO: 250400 - protein, 24 aa, Homo sapiens
  Native (MAGC1_HUMAN)
LSDEQGMSQNRLLILILSIIFIKG

SEQ ID NO: 250401 - protein, 25 aa, Homo sapiens
  Native (MAGC1_HUMAN)
LSDEQGMSQNRLLILILSIIFIKGT

SEQ ID NO: 250402 - protein, 14 aa, Homo sapiens
  Native (MAGC1_HUMAN)
LSGIGVRAGREHFA

SEQ ID NO: 250403 - protein, 15 aa, Homo sapiens
  Native (MAGC1_HUMAN)
LSGIGVRAGREHFAF

SEQ ID NO: 250404 - protein, 16 aa, Homo sapiens
  Native (MAGC1_HUMAN)
LSGIGVRAGREHFAFG

SEQ ID NO: 250405 - protein, 17 aa, Homo sapiens
  Native (MAGC1_HUMAN)
LSGIGVRAGREHFAFGE

SEQ ID NO: 250406 - protein, 18 aa, Homo sapiens
  Native (MAGC1_HUMAN)
LSGIGVRAGREHFAFGEP

SEQ ID NO: 250407 - protein, 19 aa, Homo sapiens
  Native (MAGC1_HUMAN)
LSGIGVRAGREHFAFGEPR

SEQ ID NO: 250408 - protein, 20 aa, Homo sapiens
  Native (MAGC1_HUMAN)
LSGIGVRAGREHFAFGEPRE

SEQ ID NO: 250409 - protein, 21 aa, Homo sapiens
  Native (MAGC1_HUMAN)
LSGIGVRAGREHFAFGEPREL

SEQ ID NO: 250410 - protein, 22 aa, Homo sapiens
  Native (MAGC1_HUMAN)
LSGIGVRAGREHFAFGEPRELL

SEQ ID NO: 250411 - protein, 23 aa, Homo sapiens
  Native (MAGC1_HUMAN)
LSGIGVRAGREHFAFGEPRELLT

SEQ ID NO: 250412 - protein, 24 aa, Homo sapiens
  Native (MAGC1_HUMAN)
LSGIGVRAGREHFAFGEPRELLTK

SEQ ID NO: 250413 - protein, 25 aa, Homo sapiens
  Native (MAGC1_HUMAN)
LSGIGVRAGREHFAFGEPRELLTKV

SEQ ID NO: 250414 - protein, 14 aa, Homo sapiens
  Native (MAGC1_HUMAN)
LSIFQSSPERTQST

SEQ ID NO: 250415 - protein, 15 aa, Homo sapiens
  Native (MAGC1_HUMAN)
LSIFQSSPERTQSTF

SEQ ID NO: 250416 - protein, 16 aa, Homo sapiens
  Native (MAGC1_HUMAN)
LSIFQSSPERTQSTFE

SEQ ID NO: 250417 - protein, 17 aa, Homo sapiens
  Native (MAGC1_HUMAN)
LSIFQSSPERTQSTFEG

SEQ ID NO: 250418 - protein, 19 aa, Homo sapiens
  Native (MAGC1_HUMAN)
LSIFQSSPERTQSTFEGFA

SEQ ID NO: 250419 - protein, 20 aa, Homo sapiens
  Native (MAGC1_HUMAN)
LSIFQSSPERTQSTFEGFAQ

SEQ ID NO: 250420 - protein, 21 aa, Homo sapiens
  Native (MAGC1_HUMAN)
LSIFQSSPERTQSTFEGFAQS

SEQ ID NO: 250421 - protein, 22 aa, Homo sapiens
  Native (MAGC1_HUMAN)
LSIFQSSPERTQSTFEGFAQSP

SEQ ID NO: 250422 - protein, 23 aa, Homo sapiens
  Native (MAGC1_HUMAN)
LSIFQSSPERTQSTFEGFAQSPL

SEQ ID NO: 250423 - protein, 24 aa, Homo sapiens
  Native (MAGC1_HUMAN)
LSIFQSSPERTQSTFEGFAQSPLQ

SEQ ID NO: 250424 - protein, 25 aa, Homo sapiens
  Native (MAGC1_HUMAN)
LSIFQSSPERTQSTFEGFAQSPLQI

SEQ ID NO: 250425 - protein, 14 aa, Homo sapiens
  Native (MAGC1_HUMAN)
LSIFQSSPESAQST

SEQ ID NO: 250426 - protein, 15 aa, Homo sapiens
  Native (MAGC1_HUMAN)
LSIFQSSPESAQSTF

SEQ ID NO: 250427 - protein, 16 aa, Homo sapiens
  Native (MAGC1_HUMAN)
LSIFQSSPESAQSTFE

SEQ ID NO: 250428 - protein, 17 aa, Homo sapiens
  Native (MAGC1_HUMAN)
LSIFQSSPESAQSTFEG

SEQ ID NO: 250429 - protein, 19 aa, Homo sapiens
  Native (MAGC1_HUMAN)
LSIFQSSPESAQSTFEGFP

SEQ ID NO: 250430 - protein, 20 aa, Homo sapiens
  Native (MAGC1_HUMAN)
LSIFQSSPESAQSTFEGFPQ

SEQ ID NO: 250431 - protein, 23 aa, Homo sapiens
  Native (MAGC1_HUMAN)
LSIFQSSPESAQSTFEGFPQSPL

SEQ ID NO: 250432 - protein, 24 aa, Homo sapiens
  Native (MAGC1_HUMAN)
LSIFQSSPESAQSTFEGFPQSPLQ

SEQ ID NO: 250433 - protein, 25 aa, Homo sapiens
  Native (MAGC1_HUMAN)
LSIFQSSPESAQSTFEGFPQSPLQI

SEQ ID NO: 250434 - protein, 14 aa, Homo sapiens
  Native (MAGC1_HUMAN)
LSIFQSSPESTQSP

SEQ ID NO: 250435 - protein, 15 aa, Homo sapiens
  Native (MAGC1_HUMAN)
LSIFQSSPESTQSPF

SEQ ID NO: 250436 - protein, 16 aa, Homo sapiens
  Native (MAGC1_HUMAN)
LSIFQSSPESTQSPFE

SEQ ID NO: 250437 - protein, 17 aa, Homo sapiens
  Native (MAGC1_HUMAN)
LSIFQSSPESTQSPFEG

SEQ ID NO: 250438 - protein, 20 aa, Homo sapiens
  Native (MAGC1_HUMAN)
LSIFQSSPESTQSPFEGFPQ

SEQ ID NO: 250439 - protein, 23 aa, Homo sapiens
  Native (MAGC1_HUMAN)
LSIFQSSPESTQSPFEGFPQSVL

SEQ ID NO: 250440 - protein, 24 aa, Homo sapiens
  Native (MAGC1_HUMAN)
LSIFQSSPESTQSPFEGFPQSVLQ

SEQ ID NO: 250441 - protein, 25 aa, Homo sapiens
  Native (MAGC1_HUMAN)
LSIFQSSPESTQSPFEGFPQSVLQI

SEQ ID NO: 250442 - protein, 13 aa, Homo sapiens
  Native (MAGC1_HUMAN)
LSIIFIKGTYASE

SEQ ID NO: 250443 - protein, 14 aa, Homo sapiens
  Native (MAGC1_HUMAN)
LSIIFIKGTYASEE

SEQ ID NO: 250444 - protein, 15 aa, Homo sapiens
  Native (MAGC1_HUMAN)
LSIIFIKGTYASEEV

SEQ ID NO: 250445 - protein, 16 aa, Homo sapiens
  Native (MAGC1_HUMAN)
LSIIFIKGTYASEEVI

SEQ ID NO: 250446 - protein, 17 aa, Homo sapiens
  Native (MAGC1_HUMAN)
LSIIFIKGTYASEEVIW

SEQ ID NO: 250447 - protein, 18 aa, Homo sapiens
  Native (MAGC1_HUMAN)
LSIIFIKGTYASEEVIWD

SEQ ID NO: 250448 - protein, 19 aa, Homo sapiens
  Native (MAGC1_HUMAN)
LSIIFIKGTYASEEVIWDV

SEQ ID NO: 250449 - protein, 20 aa, Homo sapiens
  Native (MAGC1_HUMAN)
LSIIFIKGTYASEEVIWDVL

SEQ ID NO: 250450 - protein, 21 aa, Homo sapiens
  Native (MAGC1_HUMAN)
LSIIFIKGTYASEEVIWDVLS

SEQ ID NO: 250451 - protein, 22 aa, Homo sapiens
  Native (MAGC1_HUMAN)
LSIIFIKGTYASEEVIWDVLSG

SEQ ID NO: 250452 - protein, 23 aa, Homo sapiens
  Native (MAGC1_HUMAN)
LSIIFIKGTYASEEVIWDVLSGI

SEQ ID NO: 250453 - protein, 24 aa, Homo sapiens
  Native (MAGC1_HUMAN)
LSIIFIKGTYASEEVIWDVLSGIG

SEQ ID NO: 250454 - protein, 25 aa, Homo sapiens
  Native (MAGC1_HUMAN)
LSIIFIKGTYASEEVIWDVLSGIGV

SEQ ID NO: 250455 - protein, 14 aa, Homo sapiens
  Native (MAGC1_HUMAN)
LSILQSSPESAQSA

SEQ ID NO: 250456 - protein, 15 aa, Homo sapiens
  Native (MAGC1_HUMAN)
LSILQSSPESAQSAF

SEQ ID NO: 250457 - protein, 16 aa, Homo sapiens
  Native (MAGC1_HUMAN)
LSILQSSPESAQSAFE

SEQ ID NO: 250458 - protein, 17 aa, Homo sapiens
  Native (MAGC1_HUMAN)
LSILQSSPESAQSAFEG

SEQ ID NO: 250459 - protein, 19 aa, Homo sapiens
  Native (MAGC1_HUMAN)
LSILQSSPESAQSAFEGFP

SEQ ID NO: 250460 - protein, 20 aa, Homo sapiens
  Native (MAGC1_HUMAN)
LSILQSSPESAQSAFEGFPQ

SEQ ID NO: 250461 - protein, 21 aa, Homo sapiens
  Native (MAGC1_HUMAN)
LSILQSSPESAQSAFEGFPQS

SEQ ID NO: 250462 - protein, 22 aa, Homo sapiens
  Native (MAGC1_HUMAN)
LSILQSSPESAQSAFEGFPQSP

SEQ ID NO: 250463 - protein, 23 aa, Homo sapiens
  Native (MAGC1_HUMAN)
LSILQSSPESAQSAFEGFPQSPL

SEQ ID NO: 250464 - protein, 24 aa, Homo sapiens
  Native (MAGC1_HUMAN)
LSILQSSPESAQSAFEGFPQSPLQ

SEQ ID NO: 250465 - protein, 25 aa, Homo sapiens
  Native (MAGC1_HUMAN)
LSILQSSPESAQSAFEGFPQSPLQI

SEQ ID NO: 250466 - protein, 20 aa, Homo sapiens
  Native (MAGC1_HUMAN)
LSKSSPESPLQSPVISFSSS

SEQ ID NO: 250467 - protein, 22 aa, Homo sapiens
  Native (MAGC1_HUMAN)
LSKSSPESPLQSPVISFSSSTS

SEQ ID NO: 250468 - protein, 23 aa, Homo sapiens
  Native (MAGC1_HUMAN)
LSKSSPESPLQSPVISFSSSTSL

SEQ ID NO: 250469 - protein, 24 aa, Homo sapiens
  Native (MAGC1_HUMAN)
LSKSSPESPLQSPVISFSSSTSLS

SEQ ID NO: 250470 - protein, 25 aa, Homo sapiens
  Native (MAGC1_HUMAN)
LSKSSPESPLQSPVISFSSSTSLSP

SEQ ID NO: 250471 - protein, 13 aa, Homo sapiens
  Native (MAGC1_HUMAN)
LSLFQSFSERTQS

SEQ ID NO: 250472 - protein, 14 aa, Homo sapiens
  Native (MAGC1_HUMAN)
LSLFQSFSERTQST

SEQ ID NO: 250473 - protein, 15 aa, Homo sapiens
  Native (MAGC1_HUMAN)
LSLFQSFSERTQSTF

SEQ ID NO: 250474 - protein, 16 aa, Homo sapiens
  Native (MAGC1_HUMAN)
LSLFQSFSERTQSTFE

SEQ ID NO: 250475 - protein, 17 aa, Homo sapiens
  Native (MAGC1_HUMAN)
LSLFQSFSERTQSTFEG

SEQ ID NO: 250476 - protein, 18 aa, Homo sapiens
  Native (MAGC1_HUMAN)
LSLFQSFSERTQSTFEGF

SEQ ID NO: 250477 - protein, 19 aa, Homo sapiens
  Native (MAGC1_HUMAN)
LSLFQSFSERTQSTFEGFA

SEQ ID NO: 250478 - protein, 20 aa, Homo sapiens
  Native (MAGC1_HUMAN)
LSLFQSFSERTQSTFEGFAQ

SEQ ID NO: 250479 - protein, 21 aa, Homo sapiens
  Native (MAGC1_HUMAN)
LSLFQSFSERTQSTFEGFAQS

SEQ ID NO: 250480 - protein, 22 aa, Homo sapiens
  Native (MAGC1_HUMAN)
LSLFQSFSERTQSTFEGFAQSS

SEQ ID NO: 250481 - protein, 23 aa, Homo sapiens
  Native (MAGC1_HUMAN)
LSLFQSFSERTQSTFEGFAQSSL

SEQ ID NO: 250482 - protein, 24 aa, Homo sapiens
  Native (MAGC1_HUMAN)
LSLFQSFSERTQSTFEGFAQSSLQ

SEQ ID NO: 250483 - protein, 25 aa, Homo sapiens
  Native (MAGC1_HUMAN)
LSLFQSFSERTQSTFEGFAQSSLQI

SEQ ID NO: 250484 - protein, 15 aa, Homo sapiens
  Native (MAGC1_HUMAN)
LSLFQSSPECTQSTF

SEQ ID NO: 250485 - protein, 19 aa, Homo sapiens
  Native (MAGC1_HUMAN)
LSLFQSSPECTQSTFEGFP

SEQ ID NO: 250486 - protein, 20 aa, Homo sapiens
  Native (MAGC1_HUMAN)
LSLFQSSPECTQSTFEGFPQ

SEQ ID NO: 250487 - protein, 21 aa, Homo sapiens
  Native (MAGC1_HUMAN)
LSLFQSSPECTQSTFEGFPQS

SEQ ID NO: 250488 - protein, 22 aa, Homo sapiens
  Native (MAGC1_HUMAN)
LSLFQSSPECTQSTFEGFPQSP

SEQ ID NO: 250489 - protein, 23 aa, Homo sapiens
  Native (MAGC1_HUMAN)
LSLFQSSPECTQSTFEGFPQSPL

SEQ ID NO: 250490 - protein, 24 aa, Homo sapiens
  Native (MAGC1_HUMAN)
LSLFQSSPECTQSTFEGFPQSPLQ

SEQ ID NO: 250491 - protein, 25 aa, Homo sapiens
  Native (MAGC1_HUMAN)
LSLFQSSPECTQSTFEGFPQSPLQI

SEQ ID NO: 250492 - protein, 14 aa, Homo sapiens
  Native (MAGC1_HUMAN)
LSLFQSSPERTHST

SEQ ID NO: 250493 - protein, 15 aa, Homo sapiens
  Native (MAGC1_HUMAN)
LSLFQSSPERTHSTF

SEQ ID NO: 250494 - protein, 16 aa, Homo sapiens
  Native (MAGC1_HUMAN)
LSLFQSSPERTHSTFE

SEQ ID NO: 250495 - protein, 17 aa, Homo sapiens
  Native (MAGC1_HUMAN)
LSLFQSSPERTHSTFEG

SEQ ID NO: 250496 - protein, 19 aa, Homo sapiens
  Native (MAGC1_HUMAN)
LSLFQSSPERTHSTFEGFP

SEQ ID NO: 250497 - protein, 20 aa, Homo sapiens
  Native (MAGC1_HUMAN)
LSLFQSSPERTHSTFEGFPQ

SEQ ID NO: 250498 - protein, 21 aa, Homo sapiens
  Native (MAGC1_HUMAN)
LSLFQSSPERTHSTFEGFPQS

SEQ ID NO: 250499 - protein, 22 aa, Homo sapiens
  Native (MAGC1_HUMAN)
LSLFQSSPERTHSTFEGFPQSL

SEQ ID NO: 250500 - protein, 23 aa, Homo sapiens
  Native (MAGC1_HUMAN)
LSLFQSSPERTHSTFEGFPQSLL

SEQ ID NO: 250501 - protein, 24 aa, Homo sapiens
  Native (MAGC1_HUMAN)
LSLFQSSPERTHSTFEGFPQSLLQ

SEQ ID NO: 250502 - protein, 25 aa, Homo sapiens
  Native (MAGC1_HUMAN)
LSLFQSSPERTHSTFEGFPQSLLQI

SEQ ID NO: 250503 - protein, 22 aa, Homo sapiens
  Native (MAGC1_HUMAN)
LSLFQSSPERTHSTFEGFPQSP

SEQ ID NO: 250504 - protein, 23 aa, Homo sapiens
  Native (MAGC1_HUMAN)
LSLFQSSPERTHSTFEGFPQSPL

SEQ ID NO: 250505 - protein, 24 aa, Homo sapiens
  Native (MAGC1_HUMAN)
LSLFQSSPERTHSTFEGFPQSPLQ

SEQ ID NO: 250506 - protein, 25 aa, Homo sapiens
  Native (MAGC1_HUMAN)
LSLFQSSPERTHSTFEGFPQSPLQI

SEQ ID NO: 250507 - protein, 15 aa, Homo sapiens
  Native (MAGC1_HUMAN)
LSPFSEESSSPVDEY

SEQ ID NO: 250508 - protein, 24 aa, Homo sapiens
  Native (MAGC1_HUMAN)
LSPLHFPQFPPQGEDFQSSLQSPV

SEQ ID NO: 250509 - protein, 25 aa, Homo sapiens
  Native (MAGC1_HUMAN)
LSPLHFPQFPPQGEDFQSSLQSPVS

SEQ ID NO: 250510 - protein, 25 aa, Homo sapiens
  Native (MAGC1_HUMAN)
LSPLQIPQSPLEGEDSLSSLHFPQS

SEQ ID NO: 250511 - protein, 14 aa, Homo sapiens
  Native (MAGC1_HUMAN)
LSQSSPVSSFPSST

SEQ ID NO: 250512 - protein, 15 aa, Homo sapiens
  Native (MAGC1_HUMAN)
LSQSSPVSSFPSSTS

SEQ ID NO: 250513 - protein, 16 aa, Homo sapiens
  Native (MAGC1_HUMAN)
LSQSSPVSSFPSSTSS

SEQ ID NO: 250514 - protein, 17 aa, Homo sapiens
  Native (MAGC1_HUMAN)
LSQSSPVSSFPSSTSSS

SEQ ID NO: 250515 - protein, 18 aa, Homo sapiens
  Native (MAGC1_HUMAN)
LSQSSPVSSFPSSTSSSL

SEQ ID NO: 250516 - protein, 19 aa, Homo sapiens
  Native (MAGC1_HUMAN)
LSQSSPVSSFPSSTSSSLS

SEQ ID NO: 250517 - protein, 20 aa, Homo sapiens
  Native (MAGC1_HUMAN)
LSQSSPVSSFPSSTSSSLSK

SEQ ID NO: 250518 - protein, 21 aa, Homo sapiens
  Native (MAGC1_HUMAN)
LSQSSPVSSFPSSTSSSLSKS

SEQ ID NO: 250519 - protein, 22 aa, Homo sapiens
  Native (MAGC1_HUMAN)
LSQSSPVSSFPSSTSSSLSKSS

SEQ ID NO: 250520 - protein, 23 aa, Homo sapiens
  Native (MAGC1_HUMAN)
LSQSSPVSSFPSSTSSSLSKSSP

SEQ ID NO: 250521 - protein, 24 aa, Homo sapiens
  Native (MAGC1_HUMAN)
LSQSSPVSSFPSSTSSSLSKSSPE

SEQ ID NO: 250522 - protein, 25 aa, Homo sapiens
  Native (MAGC1_HUMAN)
LSQSSPVSSFPSSTSSSLSKSSPES

SEQ ID NO: 250523 - protein, 14 aa, Homo sapiens
  Native (MAGC1_HUMAN)
LTDSESLIESEPLF

SEQ ID NO: 250524 - protein, 15 aa, Homo sapiens
  Native (MAGC1_HUMAN)
LTDSESLIESEPLFT

SEQ ID NO: 250525 - protein, 16 aa, Homo sapiens
  Native (MAGC1_HUMAN)
LTDSESLIESEPLFTY

SEQ ID NO: 250526 - protein, 17 aa, Homo sapiens
  Native (MAGC1_HUMAN)
LTDSESLIESEPLFTYT

SEQ ID NO: 250527 - protein, 18 aa, Homo sapiens
  Native (MAGC1_HUMAN)
LTDSESLIESEPLFTYTL

SEQ ID NO: 250528 - protein, 19 aa, Homo sapiens
  Native (MAGC1_HUMAN)
LTDSESLIESEPLFTYTLD

SEQ ID NO: 250529 - protein, 20 aa, Homo sapiens
  Native (MAGC1_HUMAN)
LTDSESLIESEPLFTYTLDE

SEQ ID NO: 250530 - protein, 21 aa, Homo sapiens
  Native (MAGC1_HUMAN)
LTDSESLIESEPLFTYTLDEK

SEQ ID NO: 250531 - protein, 22 aa, Homo sapiens
  Native (MAGC1_HUMAN)
LTDSESLIESEPLFTYTLDEKV

SEQ ID NO: 250532 - protein, 23 aa, Homo sapiens
  Native (MAGC1_HUMAN)
LTDSESLIESEPLFTYTLDEKVD

SEQ ID NO: 250533 - protein, 24 aa, Homo sapiens
  Native (MAGC1_HUMAN)
LTDSESLIESEPLFTYTLDEKVDE

SEQ ID NO: 250534 - protein, 25 aa, Homo sapiens
  Native (MAGC1_HUMAN)
LTDSESLIESEPLFTYTLDEKVDEL

SEQ ID NO: 250535 - protein, 13 aa, Homo sapiens
  Native (MAGC1_HUMAN)
LTKVWVQEHYLEY

SEQ ID NO: 250536 - protein, 14 aa, Homo sapiens
  Native (MAGC1_HUMAN)
LTKVWVQEHYLEYR

SEQ ID NO: 250537 - protein, 15 aa, Homo sapiens
  Native (MAGC1_HUMAN)
LTKVWVQEHYLEYRE

SEQ ID NO: 250538 - protein, 16 aa, Homo sapiens
  Native (MAGC1_HUMAN)
LTKVWVQEHYLEYREV

SEQ ID NO: 250539 - protein, 17 aa, Homo sapiens
  Native (MAGC1_HUMAN)
LTKVWVQEHYLEYREVP

SEQ ID NO: 250540 - protein, 18 aa, Homo sapiens
  Native (MAGC1_HUMAN)
LTKVWVQEHYLEYREVPN

SEQ ID NO: 250541 - protein, 19 aa, Homo sapiens
  Native (MAGC1_HUMAN)
LTKVWVQEHYLEYREVPNS

SEQ ID NO: 250542 - protein, 20 aa, Homo sapiens
  Native (MAGC1_HUMAN)
LTKVWVQEHYLEYREVPNSS

SEQ ID NO: 250543 - protein, 21 aa, Homo sapiens
  Native (MAGC1_HUMAN)
LTKVWVQEHYLEYREVPNSSP

SEQ ID NO: 250544 - protein, 22 aa, Homo sapiens
  Native (MAGC1_HUMAN)
LTKVWVQEHYLEYREVPNSSPP

SEQ ID NO: 250545 - protein, 23 aa, Homo sapiens
  Native (MAGC1_HUMAN)
LTKVWVQEHYLEYREVPNSSPPR

SEQ ID NO: 250546 - protein, 24 aa, Homo sapiens
  Native (MAGC1_HUMAN)
LTKVWVQEHYLEYREVPNSSPPRY

SEQ ID NO: 250547 - protein, 25 aa, Homo sapiens
  Native (MAGC1_HUMAN)
LTKVWVQEHYLEYREVPNSSPPRYE

SEQ ID NO: 250548 - protein, 14 aa, Homo sapiens
  Native (MAGC1_HUMAN)
LTNVISRYTGYFPV

SEQ ID NO: 250549 - protein, 15 aa, Homo sapiens
  Native (MAGC1_HUMAN)
LTNVISRYTGYFPVI

SEQ ID NO: 250550 - protein, 16 aa, Homo sapiens
  Native (MAGC1_HUMAN)
LTNVISRYTGYFPVIF

SEQ ID NO: 250551 - protein, 17 aa, Homo sapiens
  Native (MAGC1_HUMAN)
LTNVISRYTGYFPVIFR

SEQ ID NO: 250552 - protein, 18 aa, Homo sapiens
  Native (MAGC1_HUMAN)
LTNVISRYTGYFPVIFRK

SEQ ID NO: 250553 - protein, 19 aa, Homo sapiens
  Native (MAGC1_HUMAN)
LTNVISRYTGYFPVIFRKA

SEQ ID NO: 250554 - protein, 20 aa, Homo sapiens
  Native (MAGC1_HUMAN)
LTNVISRYTGYFPVIFRKAR

SEQ ID NO: 250555 - protein, 21 aa, Homo sapiens
  Native (MAGC1_HUMAN)
LTNVISRYTGYFPVIFRKARE

SEQ ID NO: 250556 - protein, 22 aa, Homo sapiens
  Native (MAGC1_HUMAN)
LTNVISRYTGYFPVIFRKAREF

SEQ ID NO: 250557 - protein, 23 aa, Homo sapiens
  Native (MAGC1_HUMAN)
LTNVISRYTGYFPVIFRKAREFI

SEQ ID NO: 250558 - protein, 24 aa, Homo sapiens
  Native (MAGC1_HUMAN)
LTNVISRYTGYFPVIFRKAREFIE

SEQ ID NO: 250559 - protein, 25 aa, Homo sapiens
  Native (MAGC1_HUMAN)
LTNVISRYTGYFPVIFRKAREFIEI

SEQ ID NO: 250560 - protein, 21 aa, Homo sapiens
  Native (MAGC1_HUMAN)
LTSEGCLSDEQGMSQNRLLIL

SEQ ID NO: 250561 - protein, 22 aa, Homo sapiens
  Native (MAGC1_HUMAN)
LTSEGCLSDEQGMSQNRLLILI

SEQ ID NO: 250562 - protein, 23 aa, Homo sapiens
  Native (MAGC1_HUMAN)
LTSEGCLSDEQGMSQNRLLILIL

SEQ ID NO: 250563 - protein, 24 aa, Homo sapiens
  Native (MAGC1_HUMAN)
LTSEGCLSDEQGMSQNRLLILILS

SEQ ID NO: 250564 - protein, 25 aa, Homo sapiens
  Native (MAGC1_HUMAN)
LTSEGCLSDEQGMSQNRLLILILSI

SEQ ID NO: 250565 - protein, 14 aa, Homo sapiens
  Native (MAGC1_HUMAN)
LVSIFQSSPESTQS

SEQ ID NO: 250566 - protein, 15 aa, Homo sapiens
  Native (MAGC1_HUMAN)
LVSIFQSSPESTQSP

SEQ ID NO: 250567 - protein, 16 aa, Homo sapiens
  Native (MAGC1_HUMAN)
LVSIFQSSPESTQSPF

SEQ ID NO: 250568 - protein, 17 aa, Homo sapiens
  Native (MAGC1_HUMAN)
LVSIFQSSPESTQSPFE

SEQ ID NO: 250569 - protein, 19 aa, Homo sapiens
  Native (MAGC1_HUMAN)
LVSIFQSSPESTQSPFEGF

SEQ ID NO: 250570 - protein, 20 aa, Homo sapiens
  Native (MAGC1_HUMAN)
LVSIFQSSPESTQSPFEGFP

SEQ ID NO: 250571 - protein, 24 aa, Homo sapiens
  Native (MAGC1_HUMAN)
LVSIFQSSPESTQSPFEGFPQSPL

SEQ ID NO: 250572 - protein, 25 aa, Homo sapiens
  Native (MAGC1_HUMAN)
LVSIFQSSPESTQSPFEGFPQSPLQ

SEQ ID NO: 250573 - protein, 14 aa, Homo sapiens
  Native (MAGC1_HUMAN)
LVSLFQSSPERTQS

SEQ ID NO: 250574 - protein, 15 aa, Homo sapiens
  Native (MAGC1_HUMAN)
LVSLFQSSPERTQST

SEQ ID NO: 250575 - protein, 16 aa, Homo sapiens
  Native (MAGC1_HUMAN)
LVSLFQSSPERTQSTF

SEQ ID NO: 250576 - protein, 17 aa, Homo sapiens
  Native (MAGC1_HUMAN)
LVSLFQSSPERTQSTFE

SEQ ID NO: 250577 - protein, 19 aa, Homo sapiens
  Native (MAGC1_HUMAN)
LVSLFQSSPERTQSTFEGF

SEQ ID NO: 250578 - protein, 20 aa, Homo sapiens
  Native (MAGC1_HUMAN)
LVSLFQSSPERTQSTFEGFP

SEQ ID NO: 250579 - protein, 21 aa, Homo sapiens
  Native (MAGC1_HUMAN)
LVSLFQSSPERTQSTFEGFPQ

SEQ ID NO: 250580 - protein, 22 aa, Homo sapiens
  Native (MAGC1_HUMAN)
LVSLFQSSPERTQSTFEGFPQS

SEQ ID NO: 250581 - protein, 23 aa, Homo sapiens
  Native (MAGC1_HUMAN)
LVSLFQSSPERTQSTFEGFPQSP

SEQ ID NO: 250582 - protein, 24 aa, Homo sapiens
  Native (MAGC1_HUMAN)
LVSLFQSSPERTQSTFEGFPQSPL

SEQ ID NO: 250583 - protein, 25 aa, Homo sapiens
  Native (MAGC1_HUMAN)
LVSLFQSSPERTQSTFEGFPQSPLQ

SEQ ID NO: 250584 - protein, 16 aa, Homo sapiens
  Native (MAGC1_HUMAN)
LWGPRAHSEVIKRKVV

SEQ ID NO: 250585 - protein, 17 aa, Homo sapiens
  Native (MAGC1_HUMAN)
LWGPRAHSEVIKRKVVE

SEQ ID NO: 250586 - protein, 19 aa, Homo sapiens
  Native (MAGC1_HUMAN)
LWGPRAHSEVIKRKVVEFL

SEQ ID NO: 250587 - protein, 20 aa, Homo sapiens
  Native (MAGC1_HUMAN)
LWGPRAHSEVIKRKVVEFLA

SEQ ID NO: 250588 - protein, 21 aa, Homo sapiens
  Native (MAGC1_HUMAN)
LWGPRAHSEVIKRKVVEFLAM

SEQ ID NO: 250589 - protein, 22 aa, Homo sapiens
  Native (MAGC1_HUMAN)
LWGPRAHSEVIKRKVVEFLAML

SEQ ID NO: 250590 - protein, 23 aa, Homo sapiens
  Native (MAGC1_HUMAN)
LWGPRAHSEVIKRKVVEFLAMLK

SEQ ID NO: 250591 - protein, 24 aa, Homo sapiens
  Native (MAGC1_HUMAN)
LWGPRAHSEVIKRKVVEFLAMLKN

SEQ ID NO: 250592 - protein, 25 aa, Homo sapiens
  Native (MAGC1_HUMAN)
LWGPRAHSEVIKRKVVEFLAMLKNT

SEQ ID NO: 250593 - protein, 13 aa, Homo sapiens
  Native (MAGC1_HUMAN)
LYFPQSPLQGEEF

SEQ ID NO: 250594 - protein, 14 aa, Homo sapiens
  Native (MAGC1_HUMAN)
LYFPQSPLQGEEFQ

SEQ ID NO: 250595 - protein, 15 aa, Homo sapiens
  Native (MAGC1_HUMAN)
LYFPQSPLQGEEFQS

SEQ ID NO: 250596 - protein, 16 aa, Homo sapiens
  Native (MAGC1_HUMAN)
LYFPQSPLQGEEFQSS

SEQ ID NO: 250597 - protein, 17 aa, Homo sapiens
  Native (MAGC1_HUMAN)
LYFPQSPLQGEEFQSSL

SEQ ID NO: 250598 - protein, 18 aa, Homo sapiens
  Native (MAGC1_HUMAN)
LYFPQSPLQGEEFQSSLQ

SEQ ID NO: 250599 - protein, 19 aa, Homo sapiens
  Native (MAGC1_HUMAN)
LYFPQSPLQGEEFQSSLQS

SEQ ID NO: 250600 - protein, 20 aa, Homo sapiens
  Native (MAGC1_HUMAN)
LYFPQSPLQGEEFQSSLQSP

SEQ ID NO: 250601 - protein, 21 aa, Homo sapiens
  Native (MAGC1_HUMAN)
LYFPQSPLQGEEFQSSLQSPV

SEQ ID NO: 250602 - protein, 22 aa, Homo sapiens
  Native (MAGC1_HUMAN)
LYFPQSPLQGEEFQSSLQSPVS

SEQ ID NO: 250603 - protein, 23 aa, Homo sapiens
  Native (MAGC1_HUMAN)
LYFPQSPLQGEEFQSSLQSPVSI

SEQ ID NO: 250604 - protein, 24 aa, Homo sapiens
  Native (MAGC1_HUMAN)
LYFPQSPLQGEEFQSSLQSPVSIC

SEQ ID NO: 250605 - protein, 25 aa, Homo sapiens
  Native (MAGC1_HUMAN)
LYFPQSPLQGEEFQSSLQSPVSICS

SEQ ID NO: 250606 - protein, 15 aa, Homo sapiens
  Native (MAGC1_HUMAN)
LYPLQSPQSRSEGED

SEQ ID NO: 250607 - protein, 15 aa, Homo sapiens
  Native (MAGC1_HUMAN)
MGDKDMPTAGMPSLL

SEQ ID NO: 250608 - protein, 16 aa, Homo sapiens
  Native (MAGC1_HUMAN)
MGDKDMPTAGMPSLLQ

SEQ ID NO: 250609 - protein, 17 aa, Homo sapiens
  Native (MAGC1_HUMAN)
MGDKDMPTAGMPSLLQS

SEQ ID NO: 250610 - protein, 18 aa, Homo sapiens
  Native (MAGC1_HUMAN)
MGDKDMPTAGMPSLLQSS

SEQ ID NO: 250611 - protein, 19 aa, Homo sapiens
  Native (MAGC1_HUMAN)
MGDKDMPTAGMPSLLQSSS

SEQ ID NO: 250612 - protein, 20 aa, Homo sapiens
  Native (MAGC1_HUMAN)
MGDKDMPTAGMPSLLQSSSE

SEQ ID NO: 250613 - protein, 21 aa, Homo sapiens
  Native (MAGC1_HUMAN)
MGDKDMPTAGMPSLLQSSSES

SEQ ID NO: 250614 - protein, 22 aa, Homo sapiens
  Native (MAGC1_HUMAN)
MGDKDMPTAGMPSLLQSSSESP

SEQ ID NO: 250615 - protein, 23 aa, Homo sapiens
  Native (MAGC1_HUMAN)
MGDKDMPTAGMPSLLQSSSESPQ

SEQ ID NO: 250616 - protein, 24 aa, Homo sapiens
  Native (MAGC1_HUMAN)
MGDKDMPTAGMPSLLQSSSESPQS

SEQ ID NO: 250617 - protein, 25 aa, Homo sapiens
  Native (MAGC1_HUMAN)
MGDKDMPTAGMPSLLQSSSESPQSC

SEQ ID NO: 250618 - protein, 14 aa, Homo sapiens
  Native (MAGC1_HUMAN)
MLKNTVPITFPSSY

SEQ ID NO: 250619 - protein, 15 aa, Homo sapiens
  Native (MAGC1_HUMAN)
MLKNTVPITFPSSYK

SEQ ID NO: 250620 - protein, 16 aa, Homo sapiens
  Native (MAGC1_HUMAN)
MLKNTVPITFPSSYKD

SEQ ID NO: 250621 - protein, 17 aa, Homo sapiens
  Native (MAGC1_HUMAN)
MLKNTVPITFPSSYKDA

SEQ ID NO: 250622 - protein, 19 aa, Homo sapiens
  Native (MAGC1_HUMAN)
MLKNTVPITFPSSYKDALK

SEQ ID NO: 250623 - protein, 20 aa, Homo sapiens
  Native (MAGC1_HUMAN)
MLKNTVPITFPSSYKDALKD

SEQ ID NO: 250624 - protein, 21 aa, Homo sapiens
  Native (MAGC1_HUMAN)
MLKNTVPITFPSSYKDALKDV

SEQ ID NO: 250625 - protein, 22 aa, Homo sapiens
  Native (MAGC1_HUMAN)
MLKNTVPITFPSSYKDALKDVE

SEQ ID NO: 250626 - protein, 23 aa, Homo sapiens
  Native (MAGC1_HUMAN)
MLKNTVPITFPSSYKDALKDVEE

SEQ ID NO: 250627 - protein, 24 aa, Homo sapiens
  Native (MAGC1_HUMAN)
MLKNTVPITFPSSYKDALKDVEER

SEQ ID NO: 250628 - protein, 25 aa, Homo sapiens
  Native (MAGC1_HUMAN)
MLKNTVPITFPSSYKDALKDVEERA

SEQ ID NO: 250629 - protein, 13 aa, Homo sapiens
  Native (MAGC1_HUMAN)
MLTNVISRYTGYF

SEQ ID NO: 250630 - protein, 14 aa, Homo sapiens
  Native (MAGC1_HUMAN)
MLTNVISRYTGYFP

SEQ ID NO: 250631 - protein, 15 aa, Homo sapiens
  Native (MAGC1_HUMAN)
MLTNVISRYTGYFPV

SEQ ID NO: 250632 - protein, 16 aa, Homo sapiens
  Native (MAGC1_HUMAN)
MLTNVISRYTGYFPVI

SEQ ID NO: 250633 - protein, 17 aa, Homo sapiens
  Native (MAGC1_HUMAN)
MLTNVISRYTGYFPVIF

SEQ ID NO: 250634 - protein, 18 aa, Homo sapiens
  Native (MAGC1_HUMAN)
MLTNVISRYTGYFPVIFR

SEQ ID NO: 250635 - protein, 19 aa, Homo sapiens
  Native (MAGC1_HUMAN)
MLTNVISRYTGYFPVIFRK

SEQ ID NO: 250636 - protein, 20 aa, Homo sapiens
  Native (MAGC1_HUMAN)
MLTNVISRYTGYFPVIFRKA

SEQ ID NO: 250637 - protein, 21 aa, Homo sapiens
  Native (MAGC1_HUMAN)
MLTNVISRYTGYFPVIFRKAR

SEQ ID NO: 250638 - protein, 22 aa, Homo sapiens
  Native (MAGC1_HUMAN)
MLTNVISRYTGYFPVIFRKARE

SEQ ID NO: 250639 - protein, 23 aa, Homo sapiens
  Native (MAGC1_HUMAN)
MLTNVISRYTGYFPVIFRKAREF

SEQ ID NO: 250640 - protein, 24 aa, Homo sapiens
  Native (MAGC1_HUMAN)
MLTNVISRYTGYFPVIFRKAREFI

SEQ ID NO: 250641 - protein, 25 aa, Homo sapiens
  Native (MAGC1_HUMAN)
MLTNVISRYTGYFPVIFRKAREFIE

SEQ ID NO: 250642 - protein, 13 aa, Homo sapiens
  Native (MAGC1_HUMAN)
MPTAGMPSLLQSS

SEQ ID NO: 250643 - protein, 14 aa, Homo sapiens
  Native (MAGC1_HUMAN)
MPTAGMPSLLQSSS

SEQ ID NO: 250644 - protein, 15 aa, Homo sapiens
  Native (MAGC1_HUMAN)
MPTAGMPSLLQSSSE

SEQ ID NO: 250645 - protein, 16 aa, Homo sapiens
  Native (MAGC1_HUMAN)
MPTAGMPSLLQSSSES

SEQ ID NO: 250646 - protein, 17 aa, Homo sapiens
  Native (MAGC1_HUMAN)
MPTAGMPSLLQSSSESP

SEQ ID NO: 250647 - protein, 18 aa, Homo sapiens
  Native (MAGC1_HUMAN)
MPTAGMPSLLQSSSESPQ

SEQ ID NO: 250648 - protein, 19 aa, Homo sapiens
  Native (MAGC1_HUMAN)
MPTAGMPSLLQSSSESPQS

SEQ ID NO: 250649 - protein, 20 aa, Homo sapiens
  Native (MAGC1_HUMAN)
MPTAGMPSLLQSSSESPQSC

SEQ ID NO: 250650 - protein, 21 aa, Homo sapiens
  Native (MAGC1_HUMAN)
MPTAGMPSLLQSSSESPQSCP

SEQ ID NO: 250651 - protein, 22 aa, Homo sapiens
  Native (MAGC1_HUMAN)
MPTAGMPSLLQSSSESPQSCPE

SEQ ID NO: 250652 - protein, 23 aa, Homo sapiens
  Native (MAGC1_HUMAN)
MPTAGMPSLLQSSSESPQSCPEG

SEQ ID NO: 250653 - protein, 24 aa, Homo sapiens
  Native (MAGC1_HUMAN)
MPTAGMPSLLQSSSESPQSCPEGE

SEQ ID NO: 250654 - protein, 25 aa, Homo sapiens
  Native (MAGC1_HUMAN)
MPTAGMPSLLQSSSESPQSCPEGED

SEQ ID NO: 250655 - protein, 14 aa, Homo sapiens
  Native (MAGC1_HUMAN)
MSPLYFPQSPLQGE

SEQ ID NO: 250656 - protein, 15 aa, Homo sapiens
  Native (MAGC1_HUMAN)
MSPLYFPQSPLQGEE

SEQ ID NO: 250657 - protein, 16 aa, Homo sapiens
  Native (MAGC1_HUMAN)
MSPLYFPQSPLQGEEF

SEQ ID NO: 250658 - protein, 17 aa, Homo sapiens
  Native (MAGC1_HUMAN)
MSPLYFPQSPLQGEEFQ

SEQ ID NO: 250659 - protein, 18 aa, Homo sapiens
  Native (MAGC1_HUMAN)
MSPLYFPQSPLQGEEFQS

SEQ ID NO: 250660 - protein, 19 aa, Homo sapiens
  Native (MAGC1_HUMAN)
MSPLYFPQSPLQGEEFQSS

SEQ ID NO: 250661 - protein, 20 aa, Homo sapiens
  Native (MAGC1_HUMAN)
MSPLYFPQSPLQGEEFQSSL

SEQ ID NO: 250662 - protein, 21 aa, Homo sapiens
  Native (MAGC1_HUMAN)
MSPLYFPQSPLQGEEFQSSLQ

SEQ ID NO: 250663 - protein, 22 aa, Homo sapiens
  Native (MAGC1_HUMAN)
MSPLYFPQSPLQGEEFQSSLQS

SEQ ID NO: 250664 - protein, 23 aa, Homo sapiens
  Native (MAGC1_HUMAN)
MSPLYFPQSPLQGEEFQSSLQSP

SEQ ID NO: 250665 - protein, 24 aa, Homo sapiens
  Native (MAGC1_HUMAN)
MSPLYFPQSPLQGEEFQSSLQSPV

SEQ ID NO: 250666 - protein, 25 aa, Homo sapiens
  Native (MAGC1_HUMAN)
MSPLYFPQSPLQGEEFQSSLQSPVS

SEQ ID NO: 250667 - protein, 13 aa, Homo sapiens
  Native (MAGC1_HUMAN)
MSQNRLLILILSI

SEQ ID NO: 250668 - protein, 14 aa, Homo sapiens
  Native (MAGC1_HUMAN)
MSQNRLLILILSII

SEQ ID NO: 250669 - protein, 15 aa, Homo sapiens
  Native (MAGC1_HUMAN)
MSQNRLLILILSIIF

SEQ ID NO: 250670 - protein, 16 aa, Homo sapiens
  Native (MAGC1_HUMAN)
MSQNRLLILILSIIFI

SEQ ID NO: 250671 - protein, 17 aa, Homo sapiens
  Native (MAGC1_HUMAN)
MSQNRLLILILSIIFIK

SEQ ID NO: 250672 - protein, 18 aa, Homo sapiens
  Native (MAGC1_HUMAN)
MSQNRLLILILSIIFIKG

SEQ ID NO: 250673 - protein, 19 aa, Homo sapiens
  Native (MAGC1_HUMAN)
MSQNRLLILILSIIFIKGT

SEQ ID NO: 250674 - protein, 20 aa, Homo sapiens
  Native (MAGC1_HUMAN)
MSQNRLLILILSIIFIKGTY

SEQ ID NO: 250675 - protein, 21 aa, Homo sapiens
  Native (MAGC1_HUMAN)
MSQNRLLILILSIIFIKGTYA

SEQ ID NO: 250676 - protein, 22 aa, Homo sapiens
  Native (MAGC1_HUMAN)
MSQNRLLILILSIIFIKGTYAS

SEQ ID NO: 250677 - protein, 23 aa, Homo sapiens
  Native (MAGC1_HUMAN)
MSQNRLLILILSIIFIKGTYASE

SEQ ID NO: 250678 - protein, 24 aa, Homo sapiens
  Native (MAGC1_HUMAN)
MSQNRLLILILSIIFIKGTYASEE

SEQ ID NO: 250679 - protein, 25 aa, Homo sapiens
  Native (MAGC1_HUMAN)
MSQNRLLILILSIIFIKGTYASEEV

SEQ ID NO: 250680 - protein, 13 aa, Homo sapiens
  Native (MAGC1_HUMAN)
MTSSFSSTLLSIF

SEQ ID NO: 250681 - protein, 14 aa, Homo sapiens
  Native (MAGC1_HUMAN)
MTSSFSSTLLSIFQ

SEQ ID NO: 250682 - protein, 15 aa, Homo sapiens
  Native (MAGC1_HUMAN)
MTSSFSSTLLSIFQS

SEQ ID NO: 250683 - protein, 16 aa, Homo sapiens
  Native (MAGC1_HUMAN)
MTSSFSSTLLSIFQSS

SEQ ID NO: 250684 - protein, 17 aa, Homo sapiens
  Native (MAGC1_HUMAN)
MTSSFSSTLLSIFQSSP

SEQ ID NO: 250685 - protein, 18 aa, Homo sapiens
  Native (MAGC1_HUMAN)
MTSSFSSTLLSIFQSSPE

SEQ ID NO: 250686 - protein, 19 aa, Homo sapiens
  Native (MAGC1_HUMAN)
MTSSFSSTLLSIFQSSPES

SEQ ID NO: 250687 - protein, 20 aa, Homo sapiens
  Native (MAGC1_HUMAN)
MTSSFSSTLLSIFQSSPESA

SEQ ID NO: 250688 - protein, 21 aa, Homo sapiens
  Native (MAGC1_HUMAN)
MTSSFSSTLLSIFQSSPESAQ

SEQ ID NO: 250689 - protein, 22 aa, Homo sapiens
  Native (MAGC1_HUMAN)
MTSSFSSTLLSIFQSSPESAQS

SEQ ID NO: 250690 - protein, 23 aa, Homo sapiens
  Native (MAGC1_HUMAN)
MTSSFSSTLLSIFQSSPESAQST

SEQ ID NO: 250691 - protein, 24 aa, Homo sapiens
  Native (MAGC1_HUMAN)
MTSSFSSTLLSIFQSSPESAQSTF

SEQ ID NO: 250692 - protein, 25 aa, Homo sapiens
  Native (MAGC1_HUMAN)
MTSSFSSTLLSIFQSSPESAQSTFE

SEQ ID NO: 250693 - protein, 13 aa, Homo sapiens
  Native (MAGC1_HUMAN)
MTSSFSSTLLSIL

SEQ ID NO: 250694 - protein, 14 aa, Homo sapiens
  Native (MAGC1_HUMAN)
MTSSFSSTLLSILQ

SEQ ID NO: 250695 - protein, 15 aa, Homo sapiens
  Native (MAGC1_HUMAN)
MTSSFSSTLLSILQS

SEQ ID NO: 250696 - protein, 16 aa, Homo sapiens
  Native (MAGC1_HUMAN)
MTSSFSSTLLSILQSS

SEQ ID NO: 250697 - protein, 17 aa, Homo sapiens
  Native (MAGC1_HUMAN)
MTSSFSSTLLSILQSSP

SEQ ID NO: 250698 - protein, 18 aa, Homo sapiens
  Native (MAGC1_HUMAN)
MTSSFSSTLLSILQSSPE

SEQ ID NO: 250699 - protein, 19 aa, Homo sapiens
  Native (MAGC1_HUMAN)
MTSSFSSTLLSILQSSPES

SEQ ID NO: 250700 - protein, 20 aa, Homo sapiens
  Native (MAGC1_HUMAN)
MTSSFSSTLLSILQSSPESA

SEQ ID NO: 250701 - protein, 21 aa, Homo sapiens
  Native (MAGC1_HUMAN)
MTSSFSSTLLSILQSSPESAQ

SEQ ID NO: 250702 - protein, 22 aa, Homo sapiens
  Native (MAGC1_HUMAN)
MTSSFSSTLLSILQSSPESAQS

SEQ ID NO: 250703 - protein, 23 aa, Homo sapiens
  Native (MAGC1_HUMAN)
MTSSFSSTLLSILQSSPESAQSA

SEQ ID NO: 250704 - protein, 24 aa, Homo sapiens
  Native (MAGC1_HUMAN)
MTSSFSSTLLSILQSSPESAQSAF

SEQ ID NO: 250705 - protein, 25 aa, Homo sapiens
  Native (MAGC1_HUMAN)
MTSSFSSTLLSILQSSPESAQSAFE

SEQ ID NO: 250706 - protein, 14 aa, Homo sapiens
  Native (MAGC1_HUMAN)
NPASSFFSSALLSI

SEQ ID NO: 250707 - protein, 15 aa, Homo sapiens
  Native (MAGC1_HUMAN)
NPASSFFSSALLSIF

SEQ ID NO: 250708 - protein, 16 aa, Homo sapiens
  Native (MAGC1_HUMAN)
NPASSFFSSALLSIFQ

SEQ ID NO: 250709 - protein, 17 aa, Homo sapiens
  Native (MAGC1_HUMAN)
NPASSFFSSALLSIFQS

SEQ ID NO: 250710 - protein, 18 aa, Homo sapiens
  Native (MAGC1_HUMAN)
NPASSFFSSALLSIFQSS

SEQ ID NO: 250711 - protein, 19 aa, Homo sapiens
  Native (MAGC1_HUMAN)
NPASSFFSSALLSIFQSSP

SEQ ID NO: 250712 - protein, 20 aa, Homo sapiens
  Native (MAGC1_HUMAN)
NPASSFFSSALLSIFQSSPE

SEQ ID NO: 250713 - protein, 21 aa, Homo sapiens
  Native (MAGC1_HUMAN)
NPASSFFSSALLSIFQSSPES

SEQ ID NO: 250714 - protein, 22 aa, Homo sapiens
  Native (MAGC1_HUMAN)
NPASSFFSSALLSIFQSSPEST

SEQ ID NO: 250715 - protein, 23 aa, Homo sapiens
  Native (MAGC1_HUMAN)
NPASSFFSSALLSIFQSSPESTQ

SEQ ID NO: 250716 - protein, 24 aa, Homo sapiens
  Native (MAGC1_HUMAN)
NPASSFFSSALLSIFQSSPESTQS

SEQ ID NO: 250717 - protein, 25 aa, Homo sapiens
  Native (MAGC1_HUMAN)
NPASSFFSSALLSIFQSSPESTQSP

SEQ ID NO: 250718 - protein, 15 aa, Homo sapiens
  Native (MAGC1_HUMAN)
NRLLILILSIIFIKG

SEQ ID NO: 250719 - protein, 16 aa, Homo sapiens
  Native (MAGC1_HUMAN)
NRLLILILSIIFIKGT

SEQ ID NO: 250720 - protein, 17 aa, Homo sapiens
  Native (MAGC1_HUMAN)
NRLLILILSIIFIKGTY

SEQ ID NO: 250721 - protein, 18 aa, Homo sapiens
  Native (MAGC1_HUMAN)
NRLLILILSIIFIKGTYA

SEQ ID NO: 250722 - protein, 19 aa, Homo sapiens
  Native (MAGC1_HUMAN)
NRLLILILSIIFIKGTYAS

SEQ ID NO: 250723 - protein, 20 aa, Homo sapiens
  Native (MAGC1_HUMAN)
NRLLILILSIIFIKGTYASE

SEQ ID NO: 250724 - protein, 21 aa, Homo sapiens
  Native (MAGC1_HUMAN)
NRLLILILSIIFIKGTYASEE

SEQ ID NO: 250725 - protein, 22 aa, Homo sapiens
  Native (MAGC1_HUMAN)
NRLLILILSIIFIKGTYASEEV

SEQ ID NO: 250726 - protein, 23 aa, Homo sapiens
  Native (MAGC1_HUMAN)
NRLLILILSIIFIKGTYASEEVI

SEQ ID NO: 250727 - protein, 24 aa, Homo sapiens
  Native (MAGC1_HUMAN)
NRLLILILSIIFIKGTYASEEVIW

SEQ ID NO: 250728 - protein, 25 aa, Homo sapiens
  Native (MAGC1_HUMAN)
NRLLILILSIIFIKGTYASEEVIWD

SEQ ID NO: 250729 - protein, 15 aa, Homo sapiens
  Native (MAGC1_HUMAN)
NSSPPRYEFLWGPRA

SEQ ID NO: 250730 - protein, 16 aa, Homo sapiens
  Native (MAGC1_HUMAN)
NSSPPRYEFLWGPRAH

SEQ ID NO: 250731 - protein, 17 aa, Homo sapiens
  Native (MAGC1_HUMAN)
NSSPPRYEFLWGPRAHS

SEQ ID NO: 250732 - protein, 18 aa, Homo sapiens
  Native (MAGC1_HUMAN)
NSSPPRYEFLWGPRAHSE

SEQ ID NO: 250733 - protein, 19 aa, Homo sapiens
  Native (MAGC1_HUMAN)
NSSPPRYEFLWGPRAHSEV

SEQ ID NO: 250734 - protein, 20 aa, Homo sapiens
  Native (MAGC1_HUMAN)
NSSPPRYEFLWGPRAHSEVI

SEQ ID NO: 250735 - protein, 21 aa, Homo sapiens
  Native (MAGC1_HUMAN)
NSSPPRYEFLWGPRAHSEVIK

SEQ ID NO: 250736 - protein, 22 aa, Homo sapiens
  Native (MAGC1_HUMAN)
NSSPPRYEFLWGPRAHSEVIKR

SEQ ID NO: 250737 - protein, 23 aa, Homo sapiens
  Native (MAGC1_HUMAN)
NSSPPRYEFLWGPRAHSEVIKRK

SEQ ID NO: 250738 - protein, 24 aa, Homo sapiens
  Native (MAGC1_HUMAN)
NSSPPRYEFLWGPRAHSEVIKRKV

SEQ ID NO: 250739 - protein, 25 aa, Homo sapiens
  Native (MAGC1_HUMAN)
NSSPPRYEFLWGPRAHSEVIKRKVV

SEQ ID NO: 250740 - protein, 14 aa, Homo sapiens
  Native (MAGC1_HUMAN)
NTHSPLQIVPSLPE

SEQ ID NO: 250741 - protein, 16 aa, Homo sapiens
  Native (MAGC1_HUMAN)
NTHSPLQIVPSLPEWE

SEQ ID NO: 250742 - protein, 17 aa, Homo sapiens
  Native (MAGC1_HUMAN)
NTHSPLQIVPSLPEWED

SEQ ID NO: 250743 - protein, 18 aa, Homo sapiens
  Native (MAGC1_HUMAN)
NTHSPLQIVPSLPEWEDS

SEQ ID NO: 250744 - protein, 19 aa, Homo sapiens
  Native (MAGC1_HUMAN)
NTHSPLQIVPSLPEWEDSL

SEQ ID NO: 250745 - protein, 20 aa, Homo sapiens
  Native (MAGC1_HUMAN)
NTHSPLQIVPSLPEWEDSLS

SEQ ID NO: 250746 - protein, 21 aa, Homo sapiens
  Native (MAGC1_HUMAN)
NTHSPLQIVPSLPEWEDSLSP

SEQ ID NO: 250747 - protein, 22 aa, Homo sapiens
  Native (MAGC1_HUMAN)
NTHSPLQIVPSLPEWEDSLSPH

SEQ ID NO: 250748 - protein, 23 aa, Homo sapiens
  Native (MAGC1_HUMAN)
NTHSPLQIVPSLPEWEDSLSPHY

SEQ ID NO: 250749 - protein, 24 aa, Homo sapiens
  Native (MAGC1_HUMAN)
NTHSPLQIVPSLPEWEDSLSPHYF

SEQ ID NO: 250750 - protein, 25 aa, Homo sapiens
  Native (MAGC1_HUMAN)
NTHSPLQIVPSLPEWEDSLSPHYFP

SEQ ID NO: 250751 - protein, 25 aa, Homo sapiens
  Native (MAGC1_HUMAN)
NTLDLTSEGCLSDEQGMSQNRLLIL

SEQ ID NO: 250752 - protein, 13 aa, Homo sapiens
  Native (MAGC1_HUMAN)
NVISRYTGYFPVI

SEQ ID NO: 250753 - protein, 14 aa, Homo sapiens
  Native (MAGC1_HUMAN)
NVISRYTGYFPVIF

SEQ ID NO: 250754 - protein, 15 aa, Homo sapiens
  Native (MAGC1_HUMAN)
NVISRYTGYFPVIFR

SEQ ID NO: 250755 - protein, 16 aa, Homo sapiens
  Native (MAGC1_HUMAN)
NVISRYTGYFPVIFRK

SEQ ID NO: 250756 - protein, 17 aa, Homo sapiens
  Native (MAGC1_HUMAN)
NVISRYTGYFPVIFRKA

SEQ ID NO: 250757 - protein, 18 aa, Homo sapiens
  Native (MAGC1_HUMAN)
NVISRYTGYFPVIFRKAR

SEQ ID NO: 250758 - protein, 19 aa, Homo sapiens
  Native (MAGC1_HUMAN)
NVISRYTGYFPVIFRKARE

SEQ ID NO: 250759 - protein, 20 aa, Homo sapiens
  Native (MAGC1_HUMAN)
NVISRYTGYFPVIFRKAREF

SEQ ID NO: 250760 - protein, 21 aa, Homo sapiens
  Native (MAGC1_HUMAN)
NVISRYTGYFPVIFRKAREFI

SEQ ID NO: 250761 - protein, 22 aa, Homo sapiens
  Native (MAGC1_HUMAN)
NVISRYTGYFPVIFRKAREFIE

SEQ ID NO: 250762 - protein, 23 aa, Homo sapiens
  Native (MAGC1_HUMAN)
NVISRYTGYFPVIFRKAREFIEI

SEQ ID NO: 250763 - protein, 24 aa, Homo sapiens
  Native (MAGC1_HUMAN)
NVISRYTGYFPVIFRKAREFIEIL

SEQ ID NO: 250764 - protein, 25 aa, Homo sapiens
  Native (MAGC1_HUMAN)
NVISRYTGYFPVIFRKAREFIEILF

SEQ ID NO: 250765 - protein, 15 aa, Homo sapiens
  Native (MAGC1_HUMAN)
PAQSPLQRPVSSFFS

SEQ ID NO: 250766 - protein, 17 aa, Homo sapiens
  Native (MAGC1_HUMAN)
PAQSPLQRPVSSFFSYT

SEQ ID NO: 250767 - protein, 18 aa, Homo sapiens
  Native (MAGC1_HUMAN)
PAQSPLQRPVSSFFSYTL

SEQ ID NO: 250768 - protein, 19 aa, Homo sapiens
  Native (MAGC1_HUMAN)
PAQSPLQRPVSSFFSYTLA

SEQ ID NO: 250769 - protein, 20 aa, Homo sapiens
  Native (MAGC1_HUMAN)
PAQSPLQRPVSSFFSYTLAS

SEQ ID NO: 250770 - protein, 21 aa, Homo sapiens
  Native (MAGC1_HUMAN)
PAQSPLQRPVSSFFSYTLASL

SEQ ID NO: 250771 - protein, 22 aa, Homo sapiens
  Native (MAGC1_HUMAN)
PAQSPLQRPVSSFFSYTLASLL

SEQ ID NO: 250772 - protein, 23 aa, Homo sapiens
  Native (MAGC1_HUMAN)
PAQSPLQRPVSSFFSYTLASLLQ

SEQ ID NO: 250773 - protein, 24 aa, Homo sapiens
  Native (MAGC1_HUMAN)
PAQSPLQRPVSSFFSYTLASLLQS

SEQ ID NO: 250774 - protein, 25 aa, Homo sapiens
  Native (MAGC1_HUMAN)
PAQSPLQRPVSSFFSYTLASLLQSS

SEQ ID NO: 250775 - protein, 17 aa, Homo sapiens
  Native (MAGC1_HUMAN)
PAQSPLQSPVSSFPSST

SEQ ID NO: 250776 - protein, 18 aa, Homo sapiens
  Native (MAGC1_HUMAN)
PAQSPLQSPVSSFPSSTS

SEQ ID NO: 250777 - protein, 19 aa, Homo sapiens
  Native (MAGC1_HUMAN)
PAQSPLQSPVSSFPSSTSS

SEQ ID NO: 250778 - protein, 20 aa, Homo sapiens
  Native (MAGC1_HUMAN)
PAQSPLQSPVSSFPSSTSSS

SEQ ID NO: 250779 - protein, 21 aa, Homo sapiens
  Native (MAGC1_HUMAN)
PAQSPLQSPVSSFPSSTSSSL

SEQ ID NO: 250780 - protein, 22 aa, Homo sapiens
  Native (MAGC1_HUMAN)
PAQSPLQSPVSSFPSSTSSSLS

SEQ ID NO: 250781 - protein, 23 aa, Homo sapiens
  Native (MAGC1_HUMAN)
PAQSPLQSPVSSFPSSTSSSLSQ

SEQ ID NO: 250782 - protein, 24 aa, Homo sapiens
  Native (MAGC1_HUMAN)
PAQSPLQSPVSSFPSSTSSSLSQS

SEQ ID NO: 250783 - protein, 25 aa, Homo sapiens
  Native (MAGC1_HUMAN)
PAQSPLQSPVSSFPSSTSSSLSQSS

SEQ ID NO: 250784 - protein, 13 aa, Homo sapiens
  Native (MAGC1_HUMAN)
PASSFFSSALLSI

SEQ ID NO: 250785 - protein, 14 aa, Homo sapiens
  Native (MAGC1_HUMAN)
PASSFFSSALLSIF

SEQ ID NO: 250786 - protein, 15 aa, Homo sapiens
  Native (MAGC1_HUMAN)
PASSFFSSALLSIFQ

SEQ ID NO: 250787 - protein, 16 aa, Homo sapiens
  Native (MAGC1_HUMAN)
PASSFFSSALLSIFQS

SEQ ID NO: 250788 - protein, 18 aa, Homo sapiens
  Native (MAGC1_HUMAN)
PASSFFSSALLSIFQSSP

SEQ ID NO: 250789 - protein, 19 aa, Homo sapiens
  Native (MAGC1_HUMAN)
PASSFFSSALLSIFQSSPE

SEQ ID NO: 250790 - protein, 20 aa, Homo sapiens
  Native (MAGC1_HUMAN)
PASSFFSSALLSIFQSSPES

SEQ ID NO: 250791 - protein, 21 aa, Homo sapiens
  Native (MAGC1_HUMAN)
PASSFFSSALLSIFQSSPEST

SEQ ID NO: 250792 - protein, 22 aa, Homo sapiens
  Native (MAGC1_HUMAN)
PASSFFSSALLSIFQSSPESTQ

SEQ ID NO: 250793 - protein, 23 aa, Homo sapiens
  Native (MAGC1_HUMAN)
PASSFFSSALLSIFQSSPESTQS

SEQ ID NO: 250794 - protein, 24 aa, Homo sapiens
  Native (MAGC1_HUMAN)
PASSFFSSALLSIFQSSPESTQSP

SEQ ID NO: 250795 - protein, 25 aa, Homo sapiens
  Native (MAGC1_HUMAN)
PASSFFSSALLSIFQSSPESTQSPF

SEQ ID NO: 250796 - protein, 14 aa, Homo sapiens
  Native (MAGC1_HUMAN)
PDDSYVFVNTLDLT

SEQ ID NO: 250797 - protein, 16 aa, Homo sapiens
  Native (MAGC1_HUMAN)
PDDSYVFVNTLDLTSE

SEQ ID NO: 250798 - protein, 17 aa, Homo sapiens
  Native (MAGC1_HUMAN)
PDDSYVFVNTLDLTSEG

SEQ ID NO: 250799 - protein, 18 aa, Homo sapiens
  Native (MAGC1_HUMAN)
PDDSYVFVNTLDLTSEGC

SEQ ID NO: 250800 - protein, 19 aa, Homo sapiens
  Native (MAGC1_HUMAN)
PDDSYVFVNTLDLTSEGCL

SEQ ID NO: 250801 - protein, 20 aa, Homo sapiens
  Native (MAGC1_HUMAN)
PDDSYVFVNTLDLTSEGCLS

SEQ ID NO: 250802 - protein, 21 aa, Homo sapiens
  Native (MAGC1_HUMAN)
PDDSYVFVNTLDLTSEGCLSD

SEQ ID NO: 250803 - protein, 22 aa, Homo sapiens
  Native (MAGC1_HUMAN)
PDDSYVFVNTLDLTSEGCLSDE

SEQ ID NO: 250804 - protein, 23 aa, Homo sapiens
  Native (MAGC1_HUMAN)
PDDSYVFVNTLDLTSEGCLSDEQ

SEQ ID NO: 250805 - protein, 24 aa, Homo sapiens
  Native (MAGC1_HUMAN)
PDDSYVFVNTLDLTSEGCLSDEQG

SEQ ID NO: 250806 - protein, 25 aa, Homo sapiens
  Native (MAGC1_HUMAN)
PDDSYVFVNTLDLTSEGCLSDEQGM

SEQ ID NO: 250807 - protein, 16 aa, Homo sapiens
  Native (MAGC1_HUMAN)
PECTQSTFEGFPQSPL

SEQ ID NO: 250808 - protein, 17 aa, Homo sapiens
  Native (MAGC1_HUMAN)
PECTQSTFEGFPQSPLQ

SEQ ID NO: 250809 - protein, 18 aa, Homo sapiens
  Native (MAGC1_HUMAN)
PECTQSTFEGFPQSPLQI

SEQ ID NO: 250810 - protein, 19 aa, Homo sapiens
  Native (MAGC1_HUMAN)
PECTQSTFEGFPQSPLQIP

SEQ ID NO: 250811 - protein, 20 aa, Homo sapiens
  Native (MAGC1_HUMAN)
PECTQSTFEGFPQSPLQIPQ

SEQ ID NO: 250812 - protein, 21 aa, Homo sapiens
  Native (MAGC1_HUMAN)
PECTQSTFEGFPQSPLQIPQS

SEQ ID NO: 250813 - protein, 22 aa, Homo sapiens
  Native (MAGC1_HUMAN)
PECTQSTFEGFPQSPLQIPQSP

SEQ ID NO: 250814 - protein, 23 aa, Homo sapiens
  Native (MAGC1_HUMAN)
PECTQSTFEGFPQSPLQIPQSPP

SEQ ID NO: 250815 - protein, 24 aa, Homo sapiens
  Native (MAGC1_HUMAN)
PECTQSTFEGFPQSPLQIPQSPPE

SEQ ID NO: 250816 - protein, 25 aa, Homo sapiens
  Native (MAGC1_HUMAN)
PECTQSTFEGFPQSPLQIPQSPPEG

SEQ ID NO: 250817 - protein, 17 aa, Homo sapiens
  Native (MAGC1_HUMAN)
PEGEDSLSPLQIPQSPL

SEQ ID NO: 250818 - protein, 20 aa, Homo sapiens
  Native (MAGC1_HUMAN)
PEGEDSLSPLQIPQSPLEGE

SEQ ID NO: 250819 - protein, 21 aa, Homo sapiens
  Native (MAGC1_HUMAN)
PEGEDSLSPLQIPQSPLEGED

SEQ ID NO: 250820 - protein, 22 aa, Homo sapiens
  Native (MAGC1_HUMAN)
PEGEDSLSPLQIPQSPLEGEDS

SEQ ID NO: 250821 - protein, 23 aa, Homo sapiens
  Native (MAGC1_HUMAN)
PEGEDSLSPLQIPQSPLEGEDSL

SEQ ID NO: 250822 - protein, 24 aa, Homo sapiens
  Native (MAGC1_HUMAN)
PEGEDSLSPLQIPQSPLEGEDSLS

SEQ ID NO: 250823 - protein, 25 aa, Homo sapiens
  Native (MAGC1_HUMAN)
PEGEDSLSPLQIPQSPLEGEDSLSS

SEQ ID NO: 250824 - protein, 22 aa, Homo sapiens
  Native (MAGC1_HUMAN)
PEGEDVQSPLQNPASSFFSSAL

SEQ ID NO: 250825 - protein, 23 aa, Homo sapiens
  Native (MAGC1_HUMAN)
PEGEDVQSPLQNPASSFFSSALL

SEQ ID NO: 250826 - protein, 24 aa, Homo sapiens
  Native (MAGC1_HUMAN)
PEGEDVQSPLQNPASSFFSSALLS

SEQ ID NO: 250827 - protein, 25 aa, Homo sapiens
  Native (MAGC1_HUMAN)
PEGEDVQSPLQNPASSFFSSALLSI

SEQ ID NO: 250828 - protein, 15 aa, Homo sapiens
  Native (MAGC1_HUMAN)
PEGENTHSPLQIVPS

SEQ ID NO: 250829 - protein, 16 aa, Homo sapiens
  Native (MAGC1_HUMAN)
PEGENTHSPLQIVPSL

SEQ ID NO: 250830 - protein, 17 aa, Homo sapiens
  Native (MAGC1_HUMAN)
PEGENTHSPLQIVPSLP

SEQ ID NO: 250831 - protein, 19 aa, Homo sapiens
  Native (MAGC1_HUMAN)
PEGENTHSPLQIVPSLPEW

SEQ ID NO: 250832 - protein, 20 aa, Homo sapiens
  Native (MAGC1_HUMAN)
PEGENTHSPLQIVPSLPEWE

SEQ ID NO: 250833 - protein, 21 aa, Homo sapiens
  Native (MAGC1_HUMAN)
PEGENTHSPLQIVPSLPEWED

SEQ ID NO: 250834 - protein, 22 aa, Homo sapiens
  Native (MAGC1_HUMAN)
PEGENTHSPLQIVPSLPEWEDS

SEQ ID NO: 250835 - protein, 23 aa, Homo sapiens
  Native (MAGC1_HUMAN)
PEGENTHSPLQIVPSLPEWEDSL

SEQ ID NO: 250836 - protein, 24 aa, Homo sapiens
  Native (MAGC1_HUMAN)
PEGENTHSPLQIVPSLPEWEDSLS

SEQ ID NO: 250837 - protein, 25 aa, Homo sapiens
  Native (MAGC1_HUMAN)
PEGENTHSPLQIVPSLPEWEDSLSP

SEQ ID NO: 250838 - protein, 15 aa, Homo sapiens
  Native (MAGC1_HUMAN)
PEGKDSLSPLEISQS

SEQ ID NO: 250839 - protein, 20 aa, Homo sapiens
  Native (MAGC1_HUMAN)
PEGKDSLSPLEISQSPPEGE

SEQ ID NO: 250840 - protein, 15 aa, Homo sapiens
  Native (MAGC1_HUMAN)
PEGMHSQSPLQSPES

SEQ ID NO: 250841 - protein, 20 aa, Homo sapiens
  Native (MAGC1_HUMAN)
PEGPAQSPLQRPVSSFFSYT

SEQ ID NO: 250842 - protein, 21 aa, Homo sapiens
  Native (MAGC1_HUMAN)
PEGPAQSPLQRPVSSFFSYTL

SEQ ID NO: 250843 - protein, 22 aa, Homo sapiens
  Native (MAGC1_HUMAN)
PEGPAQSPLQRPVSSFFSYTLA

SEQ ID NO: 250844 - protein, 23 aa, Homo sapiens
  Native (MAGC1_HUMAN)
PEGPAQSPLQRPVSSFFSYTLAS

SEQ ID NO: 250845 - protein, 24 aa, Homo sapiens
  Native (MAGC1_HUMAN)
PEGPAQSPLQRPVSSFFSYTLASL

SEQ ID NO: 250846 - protein, 25 aa, Homo sapiens
  Native (MAGC1_HUMAN)
PEGPAQSPLQRPVSSFFSYTLASLL

SEQ ID NO: 250847 - protein, 20 aa, Homo sapiens
  Native (MAGC1_HUMAN)
PEGPAQSPLQSPVSSFPSST

SEQ ID NO: 250848 - protein, 21 aa, Homo sapiens
  Native (MAGC1_HUMAN)
PEGPAQSPLQSPVSSFPSSTS

SEQ ID NO: 250849 - protein, 22 aa, Homo sapiens
  Native (MAGC1_HUMAN)
PEGPAQSPLQSPVSSFPSSTSS

SEQ ID NO: 250850 - protein, 23 aa, Homo sapiens
  Native (MAGC1_HUMAN)
PEGPAQSPLQSPVSSFPSSTSSS

SEQ ID NO: 250851 - protein, 24 aa, Homo sapiens
  Native (MAGC1_HUMAN)
PEGPAQSPLQSPVSSFPSSTSSSL

SEQ ID NO: 250852 - protein, 25 aa, Homo sapiens
  Native (MAGC1_HUMAN)
PEGPAQSPLQSPVSSFPSSTSSSLS

SEQ ID NO: 250853 - protein, 15 aa, Homo sapiens
  Native (MAGC1_HUMAN)
PERTHSTFEGFPQSL

SEQ ID NO: 250854 - protein, 16 aa, Homo sapiens
  Native (MAGC1_HUMAN)
PERTHSTFEGFPQSLL

SEQ ID NO: 250855 - protein, 17 aa, Homo sapiens
  Native (MAGC1_HUMAN)
PERTHSTFEGFPQSLLQ

SEQ ID NO: 250856 - protein, 18 aa, Homo sapiens
  Native (MAGC1_HUMAN)
PERTHSTFEGFPQSLLQI

SEQ ID NO: 250857 - protein, 19 aa, Homo sapiens
  Native (MAGC1_HUMAN)
PERTHSTFEGFPQSLLQIP

SEQ ID NO: 250858 - protein, 20 aa, Homo sapiens
  Native (MAGC1_HUMAN)
PERTHSTFEGFPQSLLQIPM

SEQ ID NO: 250859 - protein, 21 aa, Homo sapiens
  Native (MAGC1_HUMAN)
PERTHSTFEGFPQSLLQIPMT

SEQ ID NO: 250860 - protein, 22 aa, Homo sapiens
  Native (MAGC1_HUMAN)
PERTHSTFEGFPQSLLQIPMTS

SEQ ID NO: 250861 - protein, 23 aa, Homo sapiens
  Native (MAGC1_HUMAN)
PERTHSTFEGFPQSLLQIPMTSS

SEQ ID NO: 250862 - protein, 24 aa, Homo sapiens
  Native (MAGC1_HUMAN)
PERTHSTFEGFPQSLLQIPMTSSF

SEQ ID NO: 250863 - protein, 25 aa, Homo sapiens
  Native (MAGC1_HUMAN)
PERTHSTFEGFPQSLLQIPMTSSFS

SEQ ID NO: 250864 - protein, 16 aa, Homo sapiens
  Native (MAGC1_HUMAN)
PERTHSTFEGFPQSPL

SEQ ID NO: 250865 - protein, 17 aa, Homo sapiens
  Native (MAGC1_HUMAN)
PERTHSTFEGFPQSPLQ

SEQ ID NO: 250866 - protein, 18 aa, Homo sapiens
  Native (MAGC1_HUMAN)
PERTHSTFEGFPQSPLQI

SEQ ID NO: 250867 - protein, 19 aa, Homo sapiens
  Native (MAGC1_HUMAN)
PERTHSTFEGFPQSPLQIP

SEQ ID NO: 250868 - protein, 20 aa, Homo sapiens
  Native (MAGC1_HUMAN)
PERTHSTFEGFPQSPLQIPM

SEQ ID NO: 250869 - protein, 21 aa, Homo sapiens
  Native (MAGC1_HUMAN)
PERTHSTFEGFPQSPLQIPMT

SEQ ID NO: 250870 - protein, 22 aa, Homo sapiens
  Native (MAGC1_HUMAN)
PERTHSTFEGFPQSPLQIPMTS

SEQ ID NO: 250871 - protein, 23 aa, Homo sapiens
  Native (MAGC1_HUMAN)
PERTHSTFEGFPQSPLQIPMTSS

SEQ ID NO: 250872 - protein, 24 aa, Homo sapiens
  Native (MAGC1_HUMAN)
PERTHSTFEGFPQSPLQIPMTSSF

SEQ ID NO: 250873 - protein, 25 aa, Homo sapiens
  Native (MAGC1_HUMAN)
PERTHSTFEGFPQSPLQIPMTSSFS

SEQ ID NO: 250874 - protein, 20 aa, Homo sapiens
  Native (MAGC1_HUMAN)
PERTHSTFEGFPQSPLQIPV

SEQ ID NO: 250875 - protein, 21 aa, Homo sapiens
  Native (MAGC1_HUMAN)
PERTHSTFEGFPQSPLQIPVS

SEQ ID NO: 250876 - protein, 22 aa, Homo sapiens
  Native (MAGC1_HUMAN)
PERTHSTFEGFPQSPLQIPVSS

SEQ ID NO: 250877 - protein, 23 aa, Homo sapiens
  Native (MAGC1_HUMAN)
PERTHSTFEGFPQSPLQIPVSSS

SEQ ID NO: 250878 - protein, 24 aa, Homo sapiens
  Native (MAGC1_HUMAN)
PERTHSTFEGFPQSPLQIPVSSSS

SEQ ID NO: 250879 - protein, 25 aa, Homo sapiens
  Native (MAGC1_HUMAN)
PERTHSTFEGFPQSPLQIPVSSSSS

SEQ ID NO: 250880 - protein, 14 aa, Homo sapiens
  Native (MAGC1_HUMAN)
PERTQSTFEGFAQS

SEQ ID NO: 250881 - protein, 15 aa, Homo sapiens
  Native (MAGC1_HUMAN)
PERTQSTFEGFAQSP

SEQ ID NO: 250882 - protein, 16 aa, Homo sapiens
  Native (MAGC1_HUMAN)
PERTQSTFEGFAQSPL

SEQ ID NO: 250883 - protein, 17 aa, Homo sapiens
  Native (MAGC1_HUMAN)
PERTQSTFEGFAQSPLQ

SEQ ID NO: 250884 - protein, 18 aa, Homo sapiens
  Native (MAGC1_HUMAN)
PERTQSTFEGFAQSPLQI

SEQ ID NO: 250885 - protein, 19 aa, Homo sapiens
  Native (MAGC1_HUMAN)
PERTQSTFEGFAQSPLQIP

SEQ ID NO: 250886 - protein, 20 aa, Homo sapiens
  Native (MAGC1_HUMAN)
PERTQSTFEGFAQSPLQIPV

SEQ ID NO: 250887 - protein, 21 aa, Homo sapiens
  Native (MAGC1_HUMAN)
PERTQSTFEGFAQSPLQIPVS

SEQ ID NO: 250888 - protein, 22 aa, Homo sapiens
  Native (MAGC1_HUMAN)
PERTQSTFEGFAQSPLQIPVSP

SEQ ID NO: 250889 - protein, 23 aa, Homo sapiens
  Native (MAGC1_HUMAN)
PERTQSTFEGFAQSPLQIPVSPS

SEQ ID NO: 250890 - protein, 24 aa, Homo sapiens
  Native (MAGC1_HUMAN)
PERTQSTFEGFAQSPLQIPVSPSS

SEQ ID NO: 250891 - protein, 25 aa, Homo sapiens
  Native (MAGC1_HUMAN)
PERTQSTFEGFAQSPLQIPVSPSSS

SEQ ID NO: 250892 - protein, 15 aa, Homo sapiens
  Native (MAGC1_HUMAN)
PERTQSTFEGFPQSP

SEQ ID NO: 250893 - protein, 16 aa, Homo sapiens
  Native (MAGC1_HUMAN)
PERTQSTFEGFPQSPL

SEQ ID NO: 250894 - protein, 17 aa, Homo sapiens
  Native (MAGC1_HUMAN)
PERTQSTFEGFPQSPLQ

SEQ ID NO: 250895 - protein, 18 aa, Homo sapiens
  Native (MAGC1_HUMAN)
PERTQSTFEGFPQSPLQI

SEQ ID NO: 250896 - protein, 19 aa, Homo sapiens
  Native (MAGC1_HUMAN)
PERTQSTFEGFPQSPLQIP

SEQ ID NO: 250897 - protein, 20 aa, Homo sapiens
  Native (MAGC1_HUMAN)
PERTQSTFEGFPQSPLQIPV

SEQ ID NO: 250898 - protein, 21 aa, Homo sapiens
  Native (MAGC1_HUMAN)
PERTQSTFEGFPQSPLQIPVS

SEQ ID NO: 250899 - protein, 22 aa, Homo sapiens
  Native (MAGC1_HUMAN)
PERTQSTFEGFPQSPLQIPVSS

SEQ ID NO: 250900 - protein, 23 aa, Homo sapiens
  Native (MAGC1_HUMAN)
PERTQSTFEGFPQSPLQIPVSSS

SEQ ID NO: 250901 - protein, 24 aa, Homo sapiens
  Native (MAGC1_HUMAN)
PERTQSTFEGFPQSPLQIPVSSSS

SEQ ID NO: 250902 - protein, 25 aa, Homo sapiens
  Native (MAGC1_HUMAN)
PERTQSTFEGFPQSPLQIPVSSSSS

SEQ ID NO: 250903 - protein, 22 aa, Homo sapiens
  Native (MAGC1_HUMAN)
PESAPEGEDSLSPLQIPQSPLE

SEQ ID NO: 250904 - protein, 23 aa, Homo sapiens
  Native (MAGC1_HUMAN)
PESAPEGEDSLSPLQIPQSPLEG

SEQ ID NO: 250905 - protein, 24 aa, Homo sapiens
  Native (MAGC1_HUMAN)
PESAPEGEDSLSPLQIPQSPLEGE

SEQ ID NO: 250906 - protein, 25 aa, Homo sapiens
  Native (MAGC1_HUMAN)
PESAPEGEDSLSPLQIPQSPLEGED

SEQ ID NO: 250907 - protein, 16 aa, Homo sapiens
  Native (MAGC1_HUMAN)
PESAQSAFEGFPQSPL

SEQ ID NO: 250908 - protein, 17 aa, Homo sapiens
  Native (MAGC1_HUMAN)
PESAQSAFEGFPQSPLQ

SEQ ID NO: 250909 - protein, 19 aa, Homo sapiens
  Native (MAGC1_HUMAN)
PESAQSAFEGFPQSPLQIP

SEQ ID NO: 250910 - protein, 20 aa, Homo sapiens
  Native (MAGC1_HUMAN)
PESAQSAFEGFPQSPLQIPV

SEQ ID NO: 250911 - protein, 21 aa, Homo sapiens
  Native (MAGC1_HUMAN)
PESAQSAFEGFPQSPLQIPVS

SEQ ID NO: 250912 - protein, 22 aa, Homo sapiens
  Native (MAGC1_HUMAN)
PESAQSAFEGFPQSPLQIPVSS

SEQ ID NO: 250913 - protein, 23 aa, Homo sapiens
  Native (MAGC1_HUMAN)
PESAQSAFEGFPQSPLQIPVSSS

SEQ ID NO: 250914 - protein, 24 aa, Homo sapiens
  Native (MAGC1_HUMAN)
PESAQSAFEGFPQSPLQIPVSSSF

SEQ ID NO: 250915 - protein, 25 aa, Homo sapiens
  Native (MAGC1_HUMAN)
PESAQSAFEGFPQSPLQIPVSSSFS

SEQ ID NO: 250916 - protein, 16 aa, Homo sapiens
  Native (MAGC1_HUMAN)
PESAQSTFEGFPQSPL

SEQ ID NO: 250917 - protein, 17 aa, Homo sapiens
  Native (MAGC1_HUMAN)
PESAQSTFEGFPQSPLQ

SEQ ID NO: 250918 - protein, 19 aa, Homo sapiens
  Native (MAGC1_HUMAN)
PESAQSTFEGFPQSPLQIP

SEQ ID NO: 250919 - protein, 20 aa, Homo sapiens
  Native (MAGC1_HUMAN)
PESAQSTFEGFPQSPLQIPG

SEQ ID NO: 250920 - protein, 21 aa, Homo sapiens
  Native (MAGC1_HUMAN)
PESAQSTFEGFPQSPLQIPGS

SEQ ID NO: 250921 - protein, 22 aa, Homo sapiens
  Native (MAGC1_HUMAN)
PESAQSTFEGFPQSPLQIPGSP

SEQ ID NO: 250922 - protein, 23 aa, Homo sapiens
  Native (MAGC1_HUMAN)
PESAQSTFEGFPQSPLQIPGSPS

SEQ ID NO: 250923 - protein, 24 aa, Homo sapiens
  Native (MAGC1_HUMAN)
PESAQSTFEGFPQSPLQIPGSPSF

SEQ ID NO: 250924 - protein, 25 aa, Homo sapiens
  Native (MAGC1_HUMAN)
PESAQSTFEGFPQSPLQIPGSPSFS

SEQ ID NO: 250925 - protein, 15 aa, Homo sapiens
  Native (MAGC1_HUMAN)
PESDDTLYPLQSPQS

SEQ ID NO: 250926 - protein, 16 aa, Homo sapiens
  Native (MAGC1_HUMAN)
PESDDTLYPLQSPQSR

SEQ ID NO: 250927 - protein, 17 aa, Homo sapiens
  Native (MAGC1_HUMAN)
PESDDTLYPLQSPQSRS

SEQ ID NO: 250928 - protein, 19 aa, Homo sapiens
  Native (MAGC1_HUMAN)
PESDDTLYPLQSPQSRSEG

SEQ ID NO: 250929 - protein, 20 aa, Homo sapiens
  Native (MAGC1_HUMAN)
PESDDTLYPLQSPQSRSEGE

SEQ ID NO: 250930 - protein, 21 aa, Homo sapiens
  Native (MAGC1_HUMAN)
PESDDTLYPLQSPQSRSEGED

SEQ ID NO: 250931 - protein, 22 aa, Homo sapiens
  Native (MAGC1_HUMAN)
PESDDTLYPLQSPQSRSEGEDS

SEQ ID NO: 250932 - protein, 23 aa, Homo sapiens
  Native (MAGC1_HUMAN)
PESDDTLYPLQSPQSRSEGEDSS

SEQ ID NO: 250933 - protein, 24 aa, Homo sapiens
  Native (MAGC1_HUMAN)
PESDDTLYPLQSPQSRSEGEDSSD

SEQ ID NO: 250934 - protein, 25 aa, Homo sapiens
  Native (MAGC1_HUMAN)
PESDDTLYPLQSPQSRSEGEDSSDP

SEQ ID NO: 250935 - protein, 15 aa, Homo sapiens
  Native (MAGC1_HUMAN)
PESPLQSPVISFSSS

SEQ ID NO: 250936 - protein, 16 aa, Homo sapiens
  Native (MAGC1_HUMAN)
PESPLQSPVISFSSST

SEQ ID NO: 250937 - protein, 17 aa, Homo sapiens
  Native (MAGC1_HUMAN)
PESPLQSPVISFSSSTS

SEQ ID NO: 250938 - protein, 18 aa, Homo sapiens
  Native (MAGC1_HUMAN)
PESPLQSPVISFSSSTSL

SEQ ID NO: 250939 - protein, 19 aa, Homo sapiens
  Native (MAGC1_HUMAN)
PESPLQSPVISFSSSTSLS

SEQ ID NO: 250940 - protein, 20 aa, Homo sapiens
  Native (MAGC1_HUMAN)
PESPLQSPVISFSSSTSLSP

SEQ ID NO: 250941 - protein, 21 aa, Homo sapiens
  Native (MAGC1_HUMAN)
PESPLQSPVISFSSSTSLSPF

SEQ ID NO: 250942 - protein, 22 aa, Homo sapiens
  Native (MAGC1_HUMAN)
PESPLQSPVISFSSSTSLSPFS

SEQ ID NO: 250943 - protein, 23 aa, Homo sapiens
  Native (MAGC1_HUMAN)
PESPLQSPVISFSSSTSLSPFSE

SEQ ID NO: 250944 - protein, 24 aa, Homo sapiens
  Native (MAGC1_HUMAN)
PESPLQSPVISFSSSTSLSPFSEE

SEQ ID NO: 250945 - protein, 25 aa, Homo sapiens
  Native (MAGC1_HUMAN)
PESPLQSPVISFSSSTSLSPFSEES

SEQ ID NO: 250946 - protein, 19 aa, Homo sapiens
  Native (MAGC1_HUMAN)
PESTQSPFEGFPQSPLQIP

SEQ ID NO: 250947 - protein, 20 aa, Homo sapiens
  Native (MAGC1_HUMAN)
PESTQSPFEGFPQSPLQIPV

SEQ ID NO: 250948 - protein, 21 aa, Homo sapiens
  Native (MAGC1_HUMAN)
PESTQSPFEGFPQSPLQIPVS

SEQ ID NO: 250949 - protein, 22 aa, Homo sapiens
  Native (MAGC1_HUMAN)
PESTQSPFEGFPQSPLQIPVSR

SEQ ID NO: 250950 - protein, 23 aa, Homo sapiens
  Native (MAGC1_HUMAN)
PESTQSPFEGFPQSPLQIPVSRS

SEQ ID NO: 250951 - protein, 24 aa, Homo sapiens
  Native (MAGC1_HUMAN)
PESTQSPFEGFPQSPLQIPVSRSF

SEQ ID NO: 250952 - protein, 25 aa, Homo sapiens
  Native (MAGC1_HUMAN)
PESTQSPFEGFPQSPLQIPVSRSFS

SEQ ID NO: 250953 - protein, 15 aa, Homo sapiens
  Native (MAGC1_HUMAN)
PESTQSPFEGFPQSV

SEQ ID NO: 250954 - protein, 16 aa, Homo sapiens
  Native (MAGC1_HUMAN)
PESTQSPFEGFPQSVL

SEQ ID NO: 250955 - protein, 17 aa, Homo sapiens
  Native (MAGC1_HUMAN)
PESTQSPFEGFPQSVLQ

SEQ ID NO: 250956 - protein, 19 aa, Homo sapiens
  Native (MAGC1_HUMAN)
PESTQSPFEGFPQSVLQIP

SEQ ID NO: 250957 - protein, 20 aa, Homo sapiens
  Native (MAGC1_HUMAN)
PESTQSPFEGFPQSVLQIPV

SEQ ID NO: 250958 - protein, 21 aa, Homo sapiens
  Native (MAGC1_HUMAN)
PESTQSPFEGFPQSVLQIPVS

SEQ ID NO: 250959 - protein, 22 aa, Homo sapiens
  Native (MAGC1_HUMAN)
PESTQSPFEGFPQSVLQIPVSA

SEQ ID NO: 250960 - protein, 23 aa, Homo sapiens
  Native (MAGC1_HUMAN)
PESTQSPFEGFPQSVLQIPVSAA

SEQ ID NO: 250961 - protein, 24 aa, Homo sapiens
  Native (MAGC1_HUMAN)
PESTQSPFEGFPQSVLQIPVSAAS

SEQ ID NO: 250962 - protein, 25 aa, Homo sapiens
  Native (MAGC1_HUMAN)
PESTQSPFEGFPQSVLQIPVSAASS

SEQ ID NO: 250963 - protein, 15 aa, Homo sapiens
  Native (MAGC1_HUMAN)
PEWEDSLSPLHFPQF

SEQ ID NO: 250964 - protein, 16 aa, Homo sapiens
  Native (MAGC1_HUMAN)
PEWEDSLSPLHFPQFP

SEQ ID NO: 250965 - protein, 17 aa, Homo sapiens
  Native (MAGC1_HUMAN)
PEWEDSLSPLHFPQFPP

SEQ ID NO: 250966 - protein, 19 aa, Homo sapiens
  Native (MAGC1_HUMAN)
PEWEDSLSPLHFPQFPPQG

SEQ ID NO: 250967 - protein, 20 aa, Homo sapiens
  Native (MAGC1_HUMAN)
PEWEDSLSPLHFPQFPPQGE

SEQ ID NO: 250968 - protein, 21 aa, Homo sapiens
  Native (MAGC1_HUMAN)
PEWEDSLSPLHFPQFPPQGED

SEQ ID NO: 250969 - protein, 22 aa, Homo sapiens
  Native (MAGC1_HUMAN)
PEWEDSLSPLHFPQFPPQGEDF

SEQ ID NO: 250970 - protein, 23 aa, Homo sapiens
  Native (MAGC1_HUMAN)
PEWEDSLSPLHFPQFPPQGEDFQ

SEQ ID NO: 250971 - protein, 24 aa, Homo sapiens
  Native (MAGC1_HUMAN)
PEWEDSLSPLHFPQFPPQGEDFQS

SEQ ID NO: 250972 - protein, 25 aa, Homo sapiens
  Native (MAGC1_HUMAN)
PEWEDSLSPLHFPQFPPQGEDFQSS

SEQ ID NO: 250973 - protein, 15 aa, Homo sapiens
  Native (MAGC1_HUMAN)
PFEGFPQSPLQIPVS

SEQ ID NO: 250974 - protein, 16 aa, Homo sapiens
  Native (MAGC1_HUMAN)
PFEGFPQSPLQIPVSR

SEQ ID NO: 250975 - protein, 19 aa, Homo sapiens
  Native (MAGC1_HUMAN)
PFEGFPQSPLQIPVSRSFS

SEQ ID NO: 250976 - protein, 20 aa, Homo sapiens
  Native (MAGC1_HUMAN)
PFEGFPQSPLQIPVSRSFSS

SEQ ID NO: 250977 - protein, 21 aa, Homo sapiens
  Native (MAGC1_HUMAN)
PFEGFPQSPLQIPVSRSFSST

SEQ ID NO: 250978 - protein, 22 aa, Homo sapiens
  Native (MAGC1_HUMAN)
PFEGFPQSPLQIPVSRSFSSTL

SEQ ID NO: 250979 - protein, 23 aa, Homo sapiens
  Native (MAGC1_HUMAN)
PFEGFPQSPLQIPVSRSFSSTLL

SEQ ID NO: 250980 - protein, 24 aa, Homo sapiens
  Native (MAGC1_HUMAN)
PFEGFPQSPLQIPVSRSFSSTLLS

SEQ ID NO: 250981 - protein, 25 aa, Homo sapiens
  Native (MAGC1_HUMAN)
PFEGFPQSPLQIPVSRSFSSTLLSI

SEQ ID NO: 250982 - protein, 14 aa, Homo sapiens
  Native (MAGC1_HUMAN)
PFEGFPQSVLQIPV

SEQ ID NO: 250983 - protein, 15 aa, Homo sapiens
  Native (MAGC1_HUMAN)
PFEGFPQSVLQIPVS

SEQ ID NO: 250984 - protein, 16 aa, Homo sapiens
  Native (MAGC1_HUMAN)
PFEGFPQSVLQIPVSA

SEQ ID NO: 250985 - protein, 17 aa, Homo sapiens
  Native (MAGC1_HUMAN)
PFEGFPQSVLQIPVSAA

SEQ ID NO: 250986 - protein, 18 aa, Homo sapiens
  Native (MAGC1_HUMAN)
PFEGFPQSVLQIPVSAAS

SEQ ID NO: 250987 - protein, 19 aa, Homo sapiens
  Native (MAGC1_HUMAN)
PFEGFPQSVLQIPVSAASS

SEQ ID NO: 250988 - protein, 20 aa, Homo sapiens
  Native (MAGC1_HUMAN)
PFEGFPQSVLQIPVSAASSS

SEQ ID NO: 250989 - protein, 21 aa, Homo sapiens
  Native (MAGC1_HUMAN)
PFEGFPQSVLQIPVSAASSST

SEQ ID NO: 250990 - protein, 22 aa, Homo sapiens
  Native (MAGC1_HUMAN)
PFEGFPQSVLQIPVSAASSSTL

SEQ ID NO: 250991 - protein, 23 aa, Homo sapiens
  Native (MAGC1_HUMAN)
PFEGFPQSVLQIPVSAASSSTLV

SEQ ID NO: 250992 - protein, 24 aa, Homo sapiens
  Native (MAGC1_HUMAN)
PFEGFPQSVLQIPVSAASSSTLVS

SEQ ID NO: 250993 - protein, 25 aa, Homo sapiens
  Native (MAGC1_HUMAN)
PFEGFPQSVLQIPVSAASSSTLVSI

SEQ ID NO: 250994 - protein, 24 aa, Homo sapiens
  Native (MAGC1_HUMAN)
PFSEESSSPVDEYTSSSDTLLESD

SEQ ID NO: 250995 - protein, 25 aa, Homo sapiens
  Native (MAGC1_HUMAN)
PFSEESSSPVDEYTSSSDTLLESDS

SEQ ID NO: 250996 - protein, 13 aa, Homo sapiens
  Native (MAGC1_HUMAN)
PGSPSFSSTLLSL

SEQ ID NO: 250997 - protein, 14 aa, Homo sapiens
  Native (MAGC1_HUMAN)
PGSPSFSSTLLSLF

SEQ ID NO: 250998 - protein, 15 aa, Homo sapiens
  Native (MAGC1_HUMAN)
PGSPSFSSTLLSLFQ

SEQ ID NO: 250999 - protein, 16 aa, Homo sapiens
  Native (MAGC1_HUMAN)
PGSPSFSSTLLSLFQS

SEQ ID NO: 251000 - protein, 17 aa, Homo sapiens
  Native (MAGC1_HUMAN)
PGSPSFSSTLLSLFQSS

SEQ ID NO: 251001 - protein, 18 aa, Homo sapiens
  Native (MAGC1_HUMAN)
PGSPSFSSTLLSLFQSSP

SEQ ID NO: 251002 - protein, 19 aa, Homo sapiens
  Native (MAGC1_HUMAN)
PGSPSFSSTLLSLFQSSPE

SEQ ID NO: 251003 - protein, 20 aa, Homo sapiens
  Native (MAGC1_HUMAN)
PGSPSFSSTLLSLFQSSPER

SEQ ID NO: 251004 - protein, 21 aa, Homo sapiens
  Native (MAGC1_HUMAN)
PGSPSFSSTLLSLFQSSPERT

SEQ ID NO: 251005 - protein, 22 aa, Homo sapiens
  Native (MAGC1_HUMAN)
PGSPSFSSTLLSLFQSSPERTH

SEQ ID NO: 251006 - protein, 23 aa, Homo sapiens
  Native (MAGC1_HUMAN)
PGSPSFSSTLLSLFQSSPERTHS

SEQ ID NO: 251007 - protein, 24 aa, Homo sapiens
  Native (MAGC1_HUMAN)
PGSPSFSSTLLSLFQSSPERTHST

SEQ ID NO: 251008 - protein, 25 aa, Homo sapiens
  Native (MAGC1_HUMAN)
PGSPSFSSTLLSLFQSSPERTHSTF

SEQ ID NO: 251009 - protein, 14 aa, Homo sapiens
  Native (MAGC1_HUMAN)
PITKAEMLTNVISR

SEQ ID NO: 251010 - protein, 15 aa, Homo sapiens
  Native (MAGC1_HUMAN)
PITKAEMLTNVISRY

SEQ ID NO: 251011 - protein, 16 aa, Homo sapiens
  Native (MAGC1_HUMAN)
PITKAEMLTNVISRYT

SEQ ID NO: 251012 - protein, 17 aa, Homo sapiens
  Native (MAGC1_HUMAN)
PITKAEMLTNVISRYTG

SEQ ID NO: 251013 - protein, 18 aa, Homo sapiens
  Native (MAGC1_HUMAN)
PITKAEMLTNVISRYTGY

SEQ ID NO: 251014 - protein, 19 aa, Homo sapiens
  Native (MAGC1_HUMAN)
PITKAEMLTNVISRYTGYF

SEQ ID NO: 251015 - protein, 20 aa, Homo sapiens
  Native (MAGC1_HUMAN)
PITKAEMLTNVISRYTGYFP

SEQ ID NO: 251016 - protein, 21 aa, Homo sapiens
  Native (MAGC1_HUMAN)
PITKAEMLTNVISRYTGYFPV

SEQ ID NO: 251017 - protein, 22 aa, Homo sapiens
  Native (MAGC1_HUMAN)
PITKAEMLTNVISRYTGYFPVI

SEQ ID NO: 251018 - protein, 23 aa, Homo sapiens
  Native (MAGC1_HUMAN)
PITKAEMLTNVISRYTGYFPVIF

SEQ ID NO: 251019 - protein, 24 aa, Homo sapiens
  Native (MAGC1_HUMAN)
PITKAEMLTNVISRYTGYFPVIFR

SEQ ID NO: 251020 - protein, 25 aa, Homo sapiens
  Native (MAGC1_HUMAN)
PITKAEMLTNVISRYTGYFPVIFRK

SEQ ID NO: 251021 - protein, 16 aa, Homo sapiens
  Native (MAGC1_HUMAN)
PLEGEDSLSSLHFPQS

SEQ ID NO: 251022 - protein, 17 aa, Homo sapiens
  Native (MAGC1_HUMAN)
PLEGEDSLSSLHFPQSP

SEQ ID NO: 251023 - protein, 19 aa, Homo sapiens
  Native (MAGC1_HUMAN)
PLEGEDSLSSLHFPQSPPE

SEQ ID NO: 251024 - protein, 20 aa, Homo sapiens
  Native (MAGC1_HUMAN)
PLEGEDSLSSLHFPQSPPEW

SEQ ID NO: 251025 - protein, 21 aa, Homo sapiens
  Native (MAGC1_HUMAN)
PLEGEDSLSSLHFPQSPPEWE

SEQ ID NO: 251026 - protein, 22 aa, Homo sapiens
  Native (MAGC1_HUMAN)
PLEGEDSLSSLHFPQSPPEWED

SEQ ID NO: 251027 - protein, 23 aa, Homo sapiens
  Native (MAGC1_HUMAN)
PLEGEDSLSSLHFPQSPPEWEDS

SEQ ID NO: 251028 - protein, 24 aa, Homo sapiens
  Native (MAGC1_HUMAN)
PLEGEDSLSSLHFPQSPPEWEDSL

SEQ ID NO: 251029 - protein, 25 aa, Homo sapiens
  Native (MAGC1_HUMAN)
PLEGEDSLSSLHFPQSPPEWEDSLS

SEQ ID NO: 251030 - protein, 13 aa, Homo sapiens
  Native (MAGC1_HUMAN)
PLFTYTLDEKVDE

SEQ ID NO: 251031 - protein, 14 aa, Homo sapiens
  Native (MAGC1_HUMAN)
PLFTYTLDEKVDEL

SEQ ID NO: 251032 - protein, 15 aa, Homo sapiens
  Native (MAGC1_HUMAN)
PLFTYTLDEKVDELA

SEQ ID NO: 251033 - protein, 16 aa, Homo sapiens
  Native (MAGC1_HUMAN)
PLFTYTLDEKVDELAR

SEQ ID NO: 251034 - protein, 17 aa, Homo sapiens
  Native (MAGC1_HUMAN)
PLFTYTLDEKVDELARF

SEQ ID NO: 251035 - protein, 18 aa, Homo sapiens
  Native (MAGC1_HUMAN)
PLFTYTLDEKVDELARFL

SEQ ID NO: 251036 - protein, 19 aa, Homo sapiens
  Native (MAGC1_HUMAN)
PLFTYTLDEKVDELARFLL

SEQ ID NO: 251037 - protein, 20 aa, Homo sapiens
  Native (MAGC1_HUMAN)
PLFTYTLDEKVDELARFLLL

SEQ ID NO: 251038 - protein, 21 aa, Homo sapiens
  Native (MAGC1_HUMAN)
PLFTYTLDEKVDELARFLLLK

SEQ ID NO: 251039 - protein, 22 aa, Homo sapiens
  Native (MAGC1_HUMAN)
PLFTYTLDEKVDELARFLLLKY

SEQ ID NO: 251040 - protein, 23 aa, Homo sapiens
  Native (MAGC1_HUMAN)
PLFTYTLDEKVDELARFLLLKYQ

SEQ ID NO: 251041 - protein, 24 aa, Homo sapiens
  Native (MAGC1_HUMAN)
PLFTYTLDEKVDELARFLLLKYQV

SEQ ID NO: 251042 - protein, 25 aa, Homo sapiens
  Native (MAGC1_HUMAN)
PLFTYTLDEKVDELARFLLLKYQVK

SEQ ID NO: 251043 - protein, 22 aa, Homo sapiens
  Native (MAGC1_HUMAN)
PLHFPQFPPQGEDFQSSLQSPV

SEQ ID NO: 251044 - protein, 23 aa, Homo sapiens
  Native (MAGC1_HUMAN)
PLHFPQFPPQGEDFQSSLQSPVS

SEQ ID NO: 251045 - protein, 24 aa, Homo sapiens
  Native (MAGC1_HUMAN)
PLHFPQFPPQGEDFQSSLQSPVSI

SEQ ID NO: 251046 - protein, 25 aa, Homo sapiens
  Native (MAGC1_HUMAN)
PLHFPQFPPQGEDFQSSLQSPVSIC

SEQ ID NO: 251047 - protein, 13 aa, Homo sapiens
  Native (MAGC1_HUMAN)
PLQGEEFQSSLQS

SEQ ID NO: 251048 - protein, 14 aa, Homo sapiens
  Native (MAGC1_HUMAN)
PLQGEEFQSSLQSP

SEQ ID NO: 251049 - protein, 15 aa, Homo sapiens
  Native (MAGC1_HUMAN)
PLQGEEFQSSLQSPV

SEQ ID NO: 251050 - protein, 16 aa, Homo sapiens
  Native (MAGC1_HUMAN)
PLQGEEFQSSLQSPVS

SEQ ID NO: 251051 - protein, 17 aa, Homo sapiens
  Native (MAGC1_HUMAN)
PLQGEEFQSSLQSPVSI

SEQ ID NO: 251052 - protein, 18 aa, Homo sapiens
  Native (MAGC1_HUMAN)
PLQGEEFQSSLQSPVSIC

SEQ ID NO: 251053 - protein, 19 aa, Homo sapiens
  Native (MAGC1_HUMAN)
PLQGEEFQSSLQSPVSICS

SEQ ID NO: 251054 - protein, 20 aa, Homo sapiens
  Native (MAGC1_HUMAN)
PLQGEEFQSSLQSPVSICSS

SEQ ID NO: 251055 - protein, 21 aa, Homo sapiens
  Native (MAGC1_HUMAN)
PLQGEEFQSSLQSPVSICSSS

SEQ ID NO: 251056 - protein, 22 aa, Homo sapiens
  Native (MAGC1_HUMAN)
PLQGEEFQSSLQSPVSICSSST

SEQ ID NO: 251057 - protein, 23 aa, Homo sapiens
  Native (MAGC1_HUMAN)
PLQGEEFQSSLQSPVSICSSSTP

SEQ ID NO: 251058 - protein, 24 aa, Homo sapiens
  Native (MAGC1_HUMAN)
PLQGEEFQSSLQSPVSICSSSTPS

SEQ ID NO: 251059 - protein, 25 aa, Homo sapiens
  Native (MAGC1_HUMAN)
PLQGEEFQSSLQSPVSICSSSTPSS

SEQ ID NO: 251060 - protein, 14 aa, Homo sapiens
  Native (MAGC1_HUMAN)
PLQIPGSPSFSSTL

SEQ ID NO: 251061 - protein, 15 aa, Homo sapiens
  Native (MAGC1_HUMAN)
PLQIPGSPSFSSTLL

SEQ ID NO: 251062 - protein, 16 aa, Homo sapiens
  Native (MAGC1_HUMAN)
PLQIPGSPSFSSTLLS

SEQ ID NO: 251063 - protein, 17 aa, Homo sapiens
  Native (MAGC1_HUMAN)
PLQIPGSPSFSSTLLSL

SEQ ID NO: 251064 - protein, 18 aa, Homo sapiens
  Native (MAGC1_HUMAN)
PLQIPGSPSFSSTLLSLF

SEQ ID NO: 251065 - protein, 19 aa, Homo sapiens
  Native (MAGC1_HUMAN)
PLQIPGSPSFSSTLLSLFQ

SEQ ID NO: 251066 - protein, 20 aa, Homo sapiens
  Native (MAGC1_HUMAN)
PLQIPGSPSFSSTLLSLFQS

SEQ ID NO: 251067 - protein, 21 aa, Homo sapiens
  Native (MAGC1_HUMAN)
PLQIPGSPSFSSTLLSLFQSS

SEQ ID NO: 251068 - protein, 22 aa, Homo sapiens
  Native (MAGC1_HUMAN)
PLQIPGSPSFSSTLLSLFQSSP

SEQ ID NO: 251069 - protein, 23 aa, Homo sapiens
  Native (MAGC1_HUMAN)
PLQIPGSPSFSSTLLSLFQSSPE

SEQ ID NO: 251070 - protein, 24 aa, Homo sapiens
  Native (MAGC1_HUMAN)
PLQIPGSPSFSSTLLSLFQSSPER

SEQ ID NO: 251071 - protein, 25 aa, Homo sapiens
  Native (MAGC1_HUMAN)
PLQIPGSPSFSSTLLSLFQSSPERT

SEQ ID NO: 251072 - protein, 14 aa, Homo sapiens
  Native (MAGC1_HUMAN)
PLQIPMTSSFSSTL

SEQ ID NO: 251073 - protein, 15 aa, Homo sapiens
  Native (MAGC1_HUMAN)
PLQIPMTSSFSSTLL

SEQ ID NO: 251074 - protein, 16 aa, Homo sapiens
  Native (MAGC1_HUMAN)
PLQIPMTSSFSSTLLS

SEQ ID NO: 251075 - protein, 17 aa, Homo sapiens
  Native (MAGC1_HUMAN)
PLQIPMTSSFSSTLLSI

SEQ ID NO: 251076 - protein, 18 aa, Homo sapiens
  Native (MAGC1_HUMAN)
PLQIPMTSSFSSTLLSIL

SEQ ID NO: 251077 - protein, 19 aa, Homo sapiens
  Native (MAGC1_HUMAN)
PLQIPMTSSFSSTLLSILQ

SEQ ID NO: 251078 - protein, 20 aa, Homo sapiens
  Native (MAGC1_HUMAN)
PLQIPMTSSFSSTLLSILQS

SEQ ID NO: 251079 - protein, 21 aa, Homo sapiens
  Native (MAGC1_HUMAN)
PLQIPMTSSFSSTLLSILQSS

SEQ ID NO: 251080 - protein, 22 aa, Homo sapiens
  Native (MAGC1_HUMAN)
PLQIPMTSSFSSTLLSILQSSP

SEQ ID NO: 251081 - protein, 23 aa, Homo sapiens
  Native (MAGC1_HUMAN)
PLQIPMTSSFSSTLLSILQSSPE

SEQ ID NO: 251082 - protein, 24 aa, Homo sapiens
  Native (MAGC1_HUMAN)
PLQIPMTSSFSSTLLSILQSSPES

SEQ ID NO: 251083 - protein, 25 aa, Homo sapiens
  Native (MAGC1_HUMAN)
PLQIPMTSSFSSTLLSILQSSPESA

SEQ ID NO: 251084 - protein, 24 aa, Homo sapiens
  Native (MAGC1_HUMAN)
PLQIPQSPLEGEDSLSSLHFPQSP

SEQ ID NO: 251085 - protein, 25 aa, Homo sapiens
  Native (MAGC1_HUMAN)
PLQIPQSPLEGEDSLSSLHFPQSPP

SEQ ID NO: 251086 - protein, 24 aa, Homo sapiens
  Native (MAGC1_HUMAN)
PLQIPQSPPEGENTHSPLQIVPSL

SEQ ID NO: 251087 - protein, 25 aa, Homo sapiens
  Native (MAGC1_HUMAN)
PLQIPQSPPEGENTHSPLQIVPSLP

SEQ ID NO: 251088 - protein, 24 aa, Homo sapiens
  Native (MAGC1_HUMAN)
PLQIPQSSPESDDTLYPLQSPQSR

SEQ ID NO: 251089 - protein, 25 aa, Homo sapiens
  Native (MAGC1_HUMAN)
PLQIPQSSPESDDTLYPLQSPQSRS

SEQ ID NO: 251090 - protein, 14 aa, Homo sapiens
  Native (MAGC1_HUMAN)
PLQIPVSPSSSSTL

SEQ ID NO: 251091 - protein, 15 aa, Homo sapiens
  Native (MAGC1_HUMAN)
PLQIPVSPSSSSTLL

SEQ ID NO: 251092 - protein, 16 aa, Homo sapiens
  Native (MAGC1_HUMAN)
PLQIPVSPSSSSTLLS

SEQ ID NO: 251093 - protein, 17 aa, Homo sapiens
  Native (MAGC1_HUMAN)
PLQIPVSPSSSSTLLSL

SEQ ID NO: 251094 - protein, 18 aa, Homo sapiens
  Native (MAGC1_HUMAN)
PLQIPVSPSSSSTLLSLF

SEQ ID NO: 251095 - protein, 19 aa, Homo sapiens
  Native (MAGC1_HUMAN)
PLQIPVSPSSSSTLLSLFQ

SEQ ID NO: 251096 - protein, 20 aa, Homo sapiens
  Native (MAGC1_HUMAN)
PLQIPVSPSSSSTLLSLFQS

SEQ ID NO: 251097 - protein, 21 aa, Homo sapiens
  Native (MAGC1_HUMAN)
PLQIPVSPSSSSTLLSLFQSF

SEQ ID NO: 251098 - protein, 22 aa, Homo sapiens
  Native (MAGC1_HUMAN)
PLQIPVSPSSSSTLLSLFQSFS

SEQ ID NO: 251099 - protein, 23 aa, Homo sapiens
  Native (MAGC1_HUMAN)
PLQIPVSPSSSSTLLSLFQSFSE

SEQ ID NO: 251100 - protein, 24 aa, Homo sapiens
  Native (MAGC1_HUMAN)
PLQIPVSPSSSSTLLSLFQSFSER

SEQ ID NO: 251101 - protein, 25 aa, Homo sapiens
  Native (MAGC1_HUMAN)
PLQIPVSPSSSSTLLSLFQSFSERT

SEQ ID NO: 251102 - protein, 14 aa, Homo sapiens
  Native (MAGC1_HUMAN)
PLQIPVSRSFSSTL

SEQ ID NO: 251103 - protein, 15 aa, Homo sapiens
  Native (MAGC1_HUMAN)
PLQIPVSRSFSSTLL

SEQ ID NO: 251104 - protein, 16 aa, Homo sapiens
  Native (MAGC1_HUMAN)
PLQIPVSRSFSSTLLS

SEQ ID NO: 251105 - protein, 17 aa, Homo sapiens
  Native (MAGC1_HUMAN)
PLQIPVSRSFSSTLLSI

SEQ ID NO: 251106 - protein, 18 aa, Homo sapiens
  Native (MAGC1_HUMAN)
PLQIPVSRSFSSTLLSIF

SEQ ID NO: 251107 - protein, 19 aa, Homo sapiens
  Native (MAGC1_HUMAN)
PLQIPVSRSFSSTLLSIFQ

SEQ ID NO: 251108 - protein, 20 aa, Homo sapiens
  Native (MAGC1_HUMAN)
PLQIPVSRSFSSTLLSIFQS

SEQ ID NO: 251109 - protein, 21 aa, Homo sapiens
  Native (MAGC1_HUMAN)
PLQIPVSRSFSSTLLSIFQSS

SEQ ID NO: 251110 - protein, 22 aa, Homo sapiens
  Native (MAGC1_HUMAN)
PLQIPVSRSFSSTLLSIFQSSP

SEQ ID NO: 251111 - protein, 23 aa, Homo sapiens
  Native (MAGC1_HUMAN)
PLQIPVSRSFSSTLLSIFQSSPE

SEQ ID NO: 251112 - protein, 24 aa, Homo sapiens
  Native (MAGC1_HUMAN)
PLQIPVSRSFSSTLLSIFQSSPER

SEQ ID NO: 251113 - protein, 25 aa, Homo sapiens
  Native (MAGC1_HUMAN)
PLQIPVSRSFSSTLLSIFQSSPERT

SEQ ID NO: 251114 - protein, 14 aa, Homo sapiens
  Native (MAGC1_HUMAN)
PLQIPVSSSFSYTL

SEQ ID NO: 251115 - protein, 15 aa, Homo sapiens
  Native (MAGC1_HUMAN)
PLQIPVSSSFSYTLL

SEQ ID NO: 251116 - protein, 16 aa, Homo sapiens
  Native (MAGC1_HUMAN)
PLQIPVSSSFSYTLLS

SEQ ID NO: 251117 - protein, 17 aa, Homo sapiens
  Native (MAGC1_HUMAN)
PLQIPVSSSFSYTLLSL

SEQ ID NO: 251118 - protein, 18 aa, Homo sapiens
  Native (MAGC1_HUMAN)
PLQIPVSSSFSYTLLSLF

SEQ ID NO: 251119 - protein, 19 aa, Homo sapiens
  Native (MAGC1_HUMAN)
PLQIPVSSSFSYTLLSLFQ

SEQ ID NO: 251120 - protein, 20 aa, Homo sapiens
  Native (MAGC1_HUMAN)
PLQIPVSSSFSYTLLSLFQS

SEQ ID NO: 251121 - protein, 21 aa, Homo sapiens
  Native (MAGC1_HUMAN)
PLQIPVSSSFSYTLLSLFQSS

SEQ ID NO: 251122 - protein, 22 aa, Homo sapiens
  Native (MAGC1_HUMAN)
PLQIPVSSSFSYTLLSLFQSSP

SEQ ID NO: 251123 - protein, 23 aa, Homo sapiens
  Native (MAGC1_HUMAN)
PLQIPVSSSFSYTLLSLFQSSPE

SEQ ID NO: 251124 - protein, 24 aa, Homo sapiens
  Native (MAGC1_HUMAN)
PLQIPVSSSFSYTLLSLFQSSPER

SEQ ID NO: 251125 - protein, 25 aa, Homo sapiens
  Native (MAGC1_HUMAN)
PLQIPVSSSFSYTLLSLFQSSPERT

SEQ ID NO: 251126 - protein, 14 aa, Homo sapiens
  Native (MAGC1_HUMAN)
PLQIPVSSSSSSST

SEQ ID NO: 251127 - protein, 15 aa, Homo sapiens
  Native (MAGC1_HUMAN)
PLQIPVSSSSSSSTL

SEQ ID NO: 251128 - protein, 16 aa, Homo sapiens
  Native (MAGC1_HUMAN)
PLQIPVSSSSSSSTLL

SEQ ID NO: 251129 - protein, 17 aa, Homo sapiens
  Native (MAGC1_HUMAN)
PLQIPVSSSSSSSTLLS

SEQ ID NO: 251130 - protein, 18 aa, Homo sapiens
  Native (MAGC1_HUMAN)
PLQIPVSSSSSSSTLLSL

SEQ ID NO: 251131 - protein, 19 aa, Homo sapiens
  Native (MAGC1_HUMAN)
PLQIPVSSSSSSSTLLSLF

SEQ ID NO: 251132 - protein, 20 aa, Homo sapiens
  Native (MAGC1_HUMAN)
PLQIPVSSSSSSSTLLSLFQ

SEQ ID NO: 251133 - protein, 21 aa, Homo sapiens
  Native (MAGC1_HUMAN)
PLQIPVSSSSSSSTLLSLFQS

SEQ ID NO: 251134 - protein, 22 aa, Homo sapiens
  Native (MAGC1_HUMAN)
PLQIPVSSSSSSSTLLSLFQSS

SEQ ID NO: 251135 - protein, 23 aa, Homo sapiens
  Native (MAGC1_HUMAN)
PLQIPVSSSSSSSTLLSLFQSSP

SEQ ID NO: 251136 - protein, 24 aa, Homo sapiens
  Native (MAGC1_HUMAN)
PLQIPVSSSSSSSTLLSLFQSSPE

SEQ ID NO: 251137 - protein, 25 aa, Homo sapiens
  Native (MAGC1_HUMAN)
PLQIPVSSSSSSSTLLSLFQSSPEC

SEQ ID NO: 251138 - protein, 14 aa, Homo sapiens
  Native (MAGC1_HUMAN)
PLQIPVSSSSSSTL

SEQ ID NO: 251139 - protein, 15 aa, Homo sapiens
  Native (MAGC1_HUMAN)
PLQIPVSSSSSSTLL

SEQ ID NO: 251140 - protein, 16 aa, Homo sapiens
  Native (MAGC1_HUMAN)
PLQIPVSSSSSSTLLS

SEQ ID NO: 251141 - protein, 17 aa, Homo sapiens
  Native (MAGC1_HUMAN)
PLQIPVSSSSSSTLLSL

SEQ ID NO: 251142 - protein, 18 aa, Homo sapiens
  Native (MAGC1_HUMAN)
PLQIPVSSSSSSTLLSLF

SEQ ID NO: 251143 - protein, 19 aa, Homo sapiens
  Native (MAGC1_HUMAN)
PLQIPVSSSSSSTLLSLFQ

SEQ ID NO: 251144 - protein, 20 aa, Homo sapiens
  Native (MAGC1_HUMAN)
PLQIPVSSSSSSTLLSLFQS

SEQ ID NO: 251145 - protein, 21 aa, Homo sapiens
  Native (MAGC1_HUMAN)
PLQIPVSSSSSSTLLSLFQSS

SEQ ID NO: 251146 - protein, 22 aa, Homo sapiens
  Native (MAGC1_HUMAN)
PLQIPVSSSSSSTLLSLFQSSP

SEQ ID NO: 251147 - protein, 23 aa, Homo sapiens
  Native (MAGC1_HUMAN)
PLQIPVSSSSSSTLLSLFQSSPE

SEQ ID NO: 251148 - protein, 24 aa, Homo sapiens
  Native (MAGC1_HUMAN)
PLQIPVSSSSSSTLLSLFQSSPER

SEQ ID NO: 251149 - protein, 25 aa, Homo sapiens
  Native (MAGC1_HUMAN)
PLQIPVSSSSSSTLLSLFQSSPERT

SEQ ID NO: 251150 - protein, 14 aa, Homo sapiens
  Native (MAGC1_HUMAN)
PLQIVPSLPEWEDS

SEQ ID NO: 251151 - protein, 15 aa, Homo sapiens
  Native (MAGC1_HUMAN)
PLQIVPSLPEWEDSL

SEQ ID NO: 251152 - protein, 16 aa, Homo sapiens
  Native (MAGC1_HUMAN)
PLQIVPSLPEWEDSLS

SEQ ID NO: 251153 - protein, 17 aa, Homo sapiens
  Native (MAGC1_HUMAN)
PLQIVPSLPEWEDSLSP

SEQ ID NO: 251154 - protein, 19 aa, Homo sapiens
  Native (MAGC1_HUMAN)
PLQIVPSLPEWEDSLSPHY

SEQ ID NO: 251155 - protein, 20 aa, Homo sapiens
  Native (MAGC1_HUMAN)
PLQIVPSLPEWEDSLSPHYF

SEQ ID NO: 251156 - protein, 21 aa, Homo sapiens
  Native (MAGC1_HUMAN)
PLQIVPSLPEWEDSLSPHYFP

SEQ ID NO: 251157 - protein, 22 aa, Homo sapiens
  Native (MAGC1_HUMAN)
PLQIVPSLPEWEDSLSPHYFPQ

SEQ ID NO: 251158 - protein, 23 aa, Homo sapiens
  Native (MAGC1_HUMAN)
PLQIVPSLPEWEDSLSPHYFPQS

SEQ ID NO: 251159 - protein, 24 aa, Homo sapiens
  Native (MAGC1_HUMAN)
PLQIVPSLPEWEDSLSPHYFPQSP

SEQ ID NO: 251160 - protein, 25 aa, Homo sapiens
  Native (MAGC1_HUMAN)
PLQIVPSLPEWEDSLSPHYFPQSPP

SEQ ID NO: 251161 - protein, 14 aa, Homo sapiens
  Native (MAGC1_HUMAN)
PLQNPASSFFSSAL

SEQ ID NO: 251162 - protein, 15 aa, Homo sapiens
  Native (MAGC1_HUMAN)
PLQNPASSFFSSALL

SEQ ID NO: 251163 - protein, 16 aa, Homo sapiens
  Native (MAGC1_HUMAN)
PLQNPASSFFSSALLS

SEQ ID NO: 251164 - protein, 17 aa, Homo sapiens
  Native (MAGC1_HUMAN)
PLQNPASSFFSSALLSI

SEQ ID NO: 251165 - protein, 18 aa, Homo sapiens
  Native (MAGC1_HUMAN)
PLQNPASSFFSSALLSIF

SEQ ID NO: 251166 - protein, 19 aa, Homo sapiens
  Native (MAGC1_HUMAN)
PLQNPASSFFSSALLSIFQ

SEQ ID NO: 251167 - protein, 20 aa, Homo sapiens
  Native (MAGC1_HUMAN)
PLQNPASSFFSSALLSIFQS

SEQ ID NO: 251168 - protein, 21 aa, Homo sapiens
  Native (MAGC1_HUMAN)
PLQNPASSFFSSALLSIFQSS

SEQ ID NO: 251169 - protein, 22 aa, Homo sapiens
  Native (MAGC1_HUMAN)
PLQNPASSFFSSALLSIFQSSP

SEQ ID NO: 251170 - protein, 23 aa, Homo sapiens
  Native (MAGC1_HUMAN)
PLQNPASSFFSSALLSIFQSSPE

SEQ ID NO: 251171 - protein, 24 aa, Homo sapiens
  Native (MAGC1_HUMAN)
PLQNPASSFFSSALLSIFQSSPES

SEQ ID NO: 251172 - protein, 25 aa, Homo sapiens
  Native (MAGC1_HUMAN)
PLQNPASSFFSSALLSIFQSSPEST

SEQ ID NO: 251173 - protein, 14 aa, Homo sapiens
  Native (MAGC1_HUMAN)
PLQRPVSSFFSYTL

SEQ ID NO: 251174 - protein, 15 aa, Homo sapiens
  Native (MAGC1_HUMAN)
PLQRPVSSFFSYTLA

SEQ ID NO: 251175 - protein, 16 aa, Homo sapiens
  Native (MAGC1_HUMAN)
PLQRPVSSFFSYTLAS

SEQ ID NO: 251176 - protein, 17 aa, Homo sapiens
  Native (MAGC1_HUMAN)
PLQRPVSSFFSYTLASL

SEQ ID NO: 251177 - protein, 18 aa, Homo sapiens
  Native (MAGC1_HUMAN)
PLQRPVSSFFSYTLASLL

SEQ ID NO: 251178 - protein, 19 aa, Homo sapiens
  Native (MAGC1_HUMAN)
PLQRPVSSFFSYTLASLLQ

SEQ ID NO: 251179 - protein, 20 aa, Homo sapiens
  Native (MAGC1_HUMAN)
PLQRPVSSFFSYTLASLLQS

SEQ ID NO: 251180 - protein, 21 aa, Homo sapiens
  Native (MAGC1_HUMAN)
PLQRPVSSFFSYTLASLLQSS

SEQ ID NO: 251181 - protein, 22 aa, Homo sapiens
  Native (MAGC1_HUMAN)
PLQRPVSSFFSYTLASLLQSSH

SEQ ID NO: 251182 - protein, 23 aa, Homo sapiens
  Native (MAGC1_HUMAN)
PLQRPVSSFFSYTLASLLQSSHE

SEQ ID NO: 251183 - protein, 24 aa, Homo sapiens
  Native (MAGC1_HUMAN)
PLQRPVSSFFSYTLASLLQSSHES

SEQ ID NO: 251184 - protein, 25 aa, Homo sapiens
  Native (MAGC1_HUMAN)
PLQRPVSSFFSYTLASLLQSSHESP

SEQ ID NO: 251185 - protein, 25 aa, Homo sapiens
  Native (MAGC1_HUMAN)
PLQSPESAPEGEDSLSPLQIPQSPL

SEQ ID NO: 251186 - protein, 14 aa, Homo sapiens
  Native (MAGC1_HUMAN)
PLQSPVISFSSSTS

SEQ ID NO: 251187 - protein, 15 aa, Homo sapiens
  Native (MAGC1_HUMAN)
PLQSPVISFSSSTSL

SEQ ID NO: 251188 - protein, 16 aa, Homo sapiens
  Native (MAGC1_HUMAN)
PLQSPVISFSSSTSLS

SEQ ID NO: 251189 - protein, 17 aa, Homo sapiens
  Native (MAGC1_HUMAN)
PLQSPVISFSSSTSLSP

SEQ ID NO: 251190 - protein, 18 aa, Homo sapiens
  Native (MAGC1_HUMAN)
PLQSPVISFSSSTSLSPF

SEQ ID NO: 251191 - protein, 19 aa, Homo sapiens
  Native (MAGC1_HUMAN)
PLQSPVISFSSSTSLSPFS

SEQ ID NO: 251192 - protein, 20 aa, Homo sapiens
  Native (MAGC1_HUMAN)
PLQSPVISFSSSTSLSPFSE

SEQ ID NO: 251193 - protein, 21 aa, Homo sapiens
  Native (MAGC1_HUMAN)
PLQSPVISFSSSTSLSPFSEE

SEQ ID NO: 251194 - protein, 22 aa, Homo sapiens
  Native (MAGC1_HUMAN)
PLQSPVISFSSSTSLSPFSEES

SEQ ID NO: 251195 - protein, 23 aa, Homo sapiens
  Native (MAGC1_HUMAN)
PLQSPVISFSSSTSLSPFSEESS

SEQ ID NO: 251196 - protein, 24 aa, Homo sapiens
  Native (MAGC1_HUMAN)
PLQSPVISFSSSTSLSPFSEESSS

SEQ ID NO: 251197 - protein, 25 aa, Homo sapiens
  Native (MAGC1_HUMAN)
PLQSPVISFSSSTSLSPFSEESSSP

SEQ ID NO: 251198 - protein, 14 aa, Homo sapiens
  Native (MAGC1_HUMAN)
PLQSPVSSFPSSTS

SEQ ID NO: 251199 - protein, 15 aa, Homo sapiens
  Native (MAGC1_HUMAN)
PLQSPVSSFPSSTSS

SEQ ID NO: 251200 - protein, 16 aa, Homo sapiens
  Native (MAGC1_HUMAN)
PLQSPVSSFPSSTSSS

SEQ ID NO: 251201 - protein, 17 aa, Homo sapiens
  Native (MAGC1_HUMAN)
PLQSPVSSFPSSTSSSL

SEQ ID NO: 251202 - protein, 18 aa, Homo sapiens
  Native (MAGC1_HUMAN)
PLQSPVSSFPSSTSSSLS

SEQ ID NO: 251203 - protein, 19 aa, Homo sapiens
  Native (MAGC1_HUMAN)
PLQSPVSSFPSSTSSSLSQ

SEQ ID NO: 251204 - protein, 20 aa, Homo sapiens
  Native (MAGC1_HUMAN)
PLQSPVSSFPSSTSSSLSQS

SEQ ID NO: 251205 - protein, 21 aa, Homo sapiens
  Native (MAGC1_HUMAN)
PLQSPVSSFPSSTSSSLSQSS

SEQ ID NO: 251206 - protein, 22 aa, Homo sapiens
  Native (MAGC1_HUMAN)
PLQSPVSSFPSSTSSSLSQSSP

SEQ ID NO: 251207 - protein, 23 aa, Homo sapiens
  Native (MAGC1_HUMAN)
PLQSPVSSFPSSTSSSLSQSSPV

SEQ ID NO: 251208 - protein, 24 aa, Homo sapiens
  Native (MAGC1_HUMAN)
PLQSPVSSFPSSTSSSLSQSSPVS

SEQ ID NO: 251209 - protein, 25 aa, Homo sapiens
  Native (MAGC1_HUMAN)
PLQSPVSSFPSSTSSSLSQSSPVSS

SEQ ID NO: 251210 - protein, 13 aa, Homo sapiens
  Native (MAGC1_HUMAN)
PLYFPQSPLQGEE

SEQ ID NO: 251211 - protein, 14 aa, Homo sapiens
  Native (MAGC1_HUMAN)
PLYFPQSPLQGEEF

SEQ ID NO: 251212 - protein, 15 aa, Homo sapiens
  Native (MAGC1_HUMAN)
PLYFPQSPLQGEEFQ

SEQ ID NO: 251213 - protein, 16 aa, Homo sapiens
  Native (MAGC1_HUMAN)
PLYFPQSPLQGEEFQS

SEQ ID NO: 251214 - protein, 17 aa, Homo sapiens
  Native (MAGC1_HUMAN)
PLYFPQSPLQGEEFQSS

SEQ ID NO: 251215 - protein, 18 aa, Homo sapiens
  Native (MAGC1_HUMAN)
PLYFPQSPLQGEEFQSSL

SEQ ID NO: 251216 - protein, 19 aa, Homo sapiens
  Native (MAGC1_HUMAN)
PLYFPQSPLQGEEFQSSLQ

SEQ ID NO: 251217 - protein, 20 aa, Homo sapiens
  Native (MAGC1_HUMAN)
PLYFPQSPLQGEEFQSSLQS

SEQ ID NO: 251218 - protein, 21 aa, Homo sapiens
  Native (MAGC1_HUMAN)
PLYFPQSPLQGEEFQSSLQSP

SEQ ID NO: 251219 - protein, 22 aa, Homo sapiens
  Native (MAGC1_HUMAN)
PLYFPQSPLQGEEFQSSLQSPV

SEQ ID NO: 251220 - protein, 23 aa, Homo sapiens
  Native (MAGC1_HUMAN)
PLYFPQSPLQGEEFQSSLQSPVS

SEQ ID NO: 251221 - protein, 24 aa, Homo sapiens
  Native (MAGC1_HUMAN)
PLYFPQSPLQGEEFQSSLQSPVSI

SEQ ID NO: 251222 - protein, 25 aa, Homo sapiens
  Native (MAGC1_HUMAN)
PLYFPQSPLQGEEFQSSLQSPVSIC

SEQ ID NO: 251223 - protein, 13 aa, Homo sapiens
  Native (MAGC1_HUMAN)
PMTSSFSSTLLSI

SEQ ID NO: 251224 - protein, 14 aa, Homo sapiens
  Native (MAGC1_HUMAN)
PMTSSFSSTLLSIF

SEQ ID NO: 251225 - protein, 15 aa, Homo sapiens
  Native (MAGC1_HUMAN)
PMTSSFSSTLLSIFQ

SEQ ID NO: 251226 - protein, 16 aa, Homo sapiens
  Native (MAGC1_HUMAN)
PMTSSFSSTLLSIFQS

SEQ ID NO: 251227 - protein, 18 aa, Homo sapiens
  Native (MAGC1_HUMAN)
PMTSSFSSTLLSIFQSSP

SEQ ID NO: 251228 - protein, 19 aa, Homo sapiens
  Native (MAGC1_HUMAN)
PMTSSFSSTLLSIFQSSPE

SEQ ID NO: 251229 - protein, 20 aa, Homo sapiens
  Native (MAGC1_HUMAN)
PMTSSFSSTLLSIFQSSPES

SEQ ID NO: 251230 - protein, 21 aa, Homo sapiens
  Native (MAGC1_HUMAN)
PMTSSFSSTLLSIFQSSPESA

SEQ ID NO: 251231 - protein, 22 aa, Homo sapiens
  Native (MAGC1_HUMAN)
PMTSSFSSTLLSIFQSSPESAQ

SEQ ID NO: 251232 - protein, 23 aa, Homo sapiens
  Native (MAGC1_HUMAN)
PMTSSFSSTLLSIFQSSPESAQS

SEQ ID NO: 251233 - protein, 24 aa, Homo sapiens
  Native (MAGC1_HUMAN)
PMTSSFSSTLLSIFQSSPESAQST

SEQ ID NO: 251234 - protein, 25 aa, Homo sapiens
  Native (MAGC1_HUMAN)
PMTSSFSSTLLSIFQSSPESAQSTF

SEQ ID NO: 251235 - protein, 14 aa, Homo sapiens
  Native (MAGC1_HUMAN)
PMTSSFSSTLLSIL

SEQ ID NO: 251236 - protein, 15 aa, Homo sapiens
  Native (MAGC1_HUMAN)
PMTSSFSSTLLSILQ

SEQ ID NO: 251237 - protein, 16 aa, Homo sapiens
  Native (MAGC1_HUMAN)
PMTSSFSSTLLSILQS

SEQ ID NO: 251238 - protein, 17 aa, Homo sapiens
  Native (MAGC1_HUMAN)
PMTSSFSSTLLSILQSS

SEQ ID NO: 251239 - protein, 18 aa, Homo sapiens
  Native (MAGC1_HUMAN)
PMTSSFSSTLLSILQSSP

SEQ ID NO: 251240 - protein, 19 aa, Homo sapiens
  Native (MAGC1_HUMAN)
PMTSSFSSTLLSILQSSPE

SEQ ID NO: 251241 - protein, 20 aa, Homo sapiens
  Native (MAGC1_HUMAN)
PMTSSFSSTLLSILQSSPES

SEQ ID NO: 251242 - protein, 21 aa, Homo sapiens
  Native (MAGC1_HUMAN)
PMTSSFSSTLLSILQSSPESA

SEQ ID NO: 251243 - protein, 22 aa, Homo sapiens
  Native (MAGC1_HUMAN)
PMTSSFSSTLLSILQSSPESAQ

SEQ ID NO: 251244 - protein, 23 aa, Homo sapiens
  Native (MAGC1_HUMAN)
PMTSSFSSTLLSILQSSPESAQS

SEQ ID NO: 251245 - protein, 24 aa, Homo sapiens
  Native (MAGC1_HUMAN)
PMTSSFSSTLLSILQSSPESAQSA

SEQ ID NO: 251246 - protein, 25 aa, Homo sapiens
  Native (MAGC1_HUMAN)
PMTSSFSSTLLSILQSSPESAQSAF

SEQ ID NO: 251247 - protein, 16 aa, Homo sapiens
  Native (MAGC1_HUMAN)
PNSSPPRYEFLWGPRA

SEQ ID NO: 251248 - protein, 17 aa, Homo sapiens
  Native (MAGC1_HUMAN)
PNSSPPRYEFLWGPRAH

SEQ ID NO: 251249 - protein, 18 aa, Homo sapiens
  Native (MAGC1_HUMAN)
PNSSPPRYEFLWGPRAHS

SEQ ID NO: 251250 - protein, 19 aa, Homo sapiens
  Native (MAGC1_HUMAN)
PNSSPPRYEFLWGPRAHSE

SEQ ID NO: 251251 - protein, 20 aa, Homo sapiens
  Native (MAGC1_HUMAN)
PNSSPPRYEFLWGPRAHSEV

SEQ ID NO: 251252 - protein, 21 aa, Homo sapiens
  Native (MAGC1_HUMAN)
PNSSPPRYEFLWGPRAHSEVI

SEQ ID NO: 251253 - protein, 22 aa, Homo sapiens
  Native (MAGC1_HUMAN)
PNSSPPRYEFLWGPRAHSEVIK

SEQ ID NO: 251254 - protein, 23 aa, Homo sapiens
  Native (MAGC1_HUMAN)
PNSSPPRYEFLWGPRAHSEVIKR

SEQ ID NO: 251255 - protein, 24 aa, Homo sapiens
  Native (MAGC1_HUMAN)
PNSSPPRYEFLWGPRAHSEVIKRK

SEQ ID NO: 251256 - protein, 25 aa, Homo sapiens
  Native (MAGC1_HUMAN)
PNSSPPRYEFLWGPRAHSEVIKRKV

SEQ ID NO: 251257 - protein, 23 aa, Homo sapiens
  Native (MAGC1_HUMAN)
PPEGEDVQSPLQNPASSFFSSAL

SEQ ID NO: 251258 - protein, 24 aa, Homo sapiens
  Native (MAGC1_HUMAN)
PPEGEDVQSPLQNPASSFFSSALL

SEQ ID NO: 251259 - protein, 25 aa, Homo sapiens
  Native (MAGC1_HUMAN)
PPEGEDVQSPLQNPASSFFSSALLS

SEQ ID NO: 251260 - protein, 15 aa, Homo sapiens
  Native (MAGC1_HUMAN)
PPEGENTHSPLQIVP

SEQ ID NO: 251261 - protein, 16 aa, Homo sapiens
  Native (MAGC1_HUMAN)
PPEGENTHSPLQIVPS

SEQ ID NO: 251262 - protein, 17 aa, Homo sapiens
  Native (MAGC1_HUMAN)
PPEGENTHSPLQIVPSL

SEQ ID NO: 251263 - protein, 19 aa, Homo sapiens
  Native (MAGC1_HUMAN)
PPEGENTHSPLQIVPSLPE

SEQ ID NO: 251264 - protein, 20 aa, Homo sapiens
  Native (MAGC1_HUMAN)
PPEGENTHSPLQIVPSLPEW

SEQ ID NO: 251265 - protein, 21 aa, Homo sapiens
  Native (MAGC1_HUMAN)
PPEGENTHSPLQIVPSLPEWE

SEQ ID NO: 251266 - protein, 22 aa, Homo sapiens
  Native (MAGC1_HUMAN)
PPEGENTHSPLQIVPSLPEWED

SEQ ID NO: 251267 - protein, 23 aa, Homo sapiens
  Native (MAGC1_HUMAN)
PPEGENTHSPLQIVPSLPEWEDS

SEQ ID NO: 251268 - protein, 24 aa, Homo sapiens
  Native (MAGC1_HUMAN)
PPEGENTHSPLQIVPSLPEWEDSL

SEQ ID NO: 251269 - protein, 25 aa, Homo sapiens
  Native (MAGC1_HUMAN)
PPEGENTHSPLQIVPSLPEWEDSLS

SEQ ID NO: 251270 - protein, 15 aa, Homo sapiens
  Native (MAGC1_HUMAN)
PPEGMHSQSPLQSPE

SEQ ID NO: 251271 - protein, 20 aa, Homo sapiens
  Native (MAGC1_HUMAN)
PPEGMHSQSPLQSPESAPEG

SEQ ID NO: 251272 - protein, 22 aa, Homo sapiens
  Native (MAGC1_HUMAN)
PPEGPAQSPLQRPVSSFFSYTL

SEQ ID NO: 251273 - protein, 23 aa, Homo sapiens
  Native (MAGC1_HUMAN)
PPEGPAQSPLQRPVSSFFSYTLA

SEQ ID NO: 251274 - protein, 24 aa, Homo sapiens
  Native (MAGC1_HUMAN)
PPEGPAQSPLQRPVSSFFSYTLAS

SEQ ID NO: 251275 - protein, 25 aa, Homo sapiens
  Native (MAGC1_HUMAN)
PPEGPAQSPLQRPVSSFFSYTLASL

SEQ ID NO: 251276 - protein, 22 aa, Homo sapiens
  Native (MAGC1_HUMAN)
PPEGPAQSPLQSPVSSFPSSTS

SEQ ID NO: 251277 - protein, 23 aa, Homo sapiens
  Native (MAGC1_HUMAN)
PPEGPAQSPLQSPVSSFPSSTSS

SEQ ID NO: 251278 - protein, 24 aa, Homo sapiens
  Native (MAGC1_HUMAN)
PPEGPAQSPLQSPVSSFPSSTSSS

SEQ ID NO: 251279 - protein, 25 aa, Homo sapiens
  Native (MAGC1_HUMAN)
PPEGPAQSPLQSPVSSFPSSTSSSL

SEQ ID NO: 251280 - protein, 17 aa, Homo sapiens
  Native (MAGC1_HUMAN)
PPEWEDSLSPLHFPQFP

SEQ ID NO: 251281 - protein, 19 aa, Homo sapiens
  Native (MAGC1_HUMAN)
PPEWEDSLSPLHFPQFPPQ

SEQ ID NO: 251282 - protein, 20 aa, Homo sapiens
  Native (MAGC1_HUMAN)
PPEWEDSLSPLHFPQFPPQG

SEQ ID NO: 251283 - protein, 21 aa, Homo sapiens
  Native (MAGC1_HUMAN)
PPEWEDSLSPLHFPQFPPQGE

SEQ ID NO: 251284 - protein, 22 aa, Homo sapiens
  Native (MAGC1_HUMAN)
PPEWEDSLSPLHFPQFPPQGED

SEQ ID NO: 251285 - protein, 23 aa, Homo sapiens
  Native (MAGC1_HUMAN)
PPEWEDSLSPLHFPQFPPQGEDF

SEQ ID NO: 251286 - protein, 24 aa, Homo sapiens
  Native (MAGC1_HUMAN)
PPEWEDSLSPLHFPQFPPQGEDFQ

SEQ ID NO: 251287 - protein, 25 aa, Homo sapiens
  Native (MAGC1_HUMAN)
PPEWEDSLSPLHFPQFPPQGEDFQS

SEQ ID NO: 251288 - protein, 15 aa, Homo sapiens
  Native (MAGC1_HUMAN)
PPQGEDFQSSLQSPV

SEQ ID NO: 251289 - protein, 16 aa, Homo sapiens
  Native (MAGC1_HUMAN)
PPQGEDFQSSLQSPVS

SEQ ID NO: 251290 - protein, 17 aa, Homo sapiens
  Native (MAGC1_HUMAN)
PPQGEDFQSSLQSPVSI

SEQ ID NO: 251291 - protein, 19 aa, Homo sapiens
  Native (MAGC1_HUMAN)
PPQGEDFQSSLQSPVSICS

SEQ ID NO: 251292 - protein, 20 aa, Homo sapiens
  Native (MAGC1_HUMAN)
PPQGEDFQSSLQSPVSICSS

SEQ ID NO: 251293 - protein, 21 aa, Homo sapiens
  Native (MAGC1_HUMAN)
PPQGEDFQSSLQSPVSICSSS

SEQ ID NO: 251294 - protein, 22 aa, Homo sapiens
  Native (MAGC1_HUMAN)
PPQGEDFQSSLQSPVSICSSST

SEQ ID NO: 251295 - protein, 23 aa, Homo sapiens
  Native (MAGC1_HUMAN)
PPQGEDFQSSLQSPVSICSSSTS

SEQ ID NO: 251296 - protein, 24 aa, Homo sapiens
  Native (MAGC1_HUMAN)
PPQGEDFQSSLQSPVSICSSSTSL

SEQ ID NO: 251297 - protein, 25 aa, Homo sapiens
  Native (MAGC1_HUMAN)
PPQGEDFQSSLQSPVSICSSSTSLS

SEQ ID NO: 251298 - protein, 20 aa, Homo sapiens
  Native (MAGC1_HUMAN)
PPQGEDSMSPLYFPQSPLQG

SEQ ID NO: 251299 - protein, 21 aa, Homo sapiens
  Native (MAGC1_HUMAN)
PPQGEDSMSPLYFPQSPLQGE

SEQ ID NO: 251300 - protein, 22 aa, Homo sapiens
  Native (MAGC1_HUMAN)
PPQGEDSMSPLYFPQSPLQGEE

SEQ ID NO: 251301 - protein, 23 aa, Homo sapiens
  Native (MAGC1_HUMAN)
PPQGEDSMSPLYFPQSPLQGEEF

SEQ ID NO: 251302 - protein, 24 aa, Homo sapiens
  Native (MAGC1_HUMAN)
PPQGEDSMSPLYFPQSPLQGEEFQ

SEQ ID NO: 251303 - protein, 25 aa, Homo sapiens
  Native (MAGC1_HUMAN)
PPQGEDSMSPLYFPQSPLQGEEFQS

SEQ ID NO: 251304 - protein, 13 aa, Homo sapiens
  Native (MAGC1_HUMAN)
PPRYEFLWGPRAH

SEQ ID NO: 251305 - protein, 14 aa, Homo sapiens
  Native (MAGC1_HUMAN)
PPRYEFLWGPRAHS

SEQ ID NO: 251306 - protein, 15 aa, Homo sapiens
  Native (MAGC1_HUMAN)
PPRYEFLWGPRAHSE

SEQ ID NO: 251307 - protein, 16 aa, Homo sapiens
  Native (MAGC1_HUMAN)
PPRYEFLWGPRAHSEV

SEQ ID NO: 251308 - protein, 17 aa, Homo sapiens
  Native (MAGC1_HUMAN)
PPRYEFLWGPRAHSEVI

SEQ ID NO: 251309 - protein, 18 aa, Homo sapiens
  Native (MAGC1_HUMAN)
PPRYEFLWGPRAHSEVIK

SEQ ID NO: 251310 - protein, 19 aa, Homo sapiens
  Native (MAGC1_HUMAN)
PPRYEFLWGPRAHSEVIKR

SEQ ID NO: 251311 - protein, 20 aa, Homo sapiens
  Native (MAGC1_HUMAN)
PPRYEFLWGPRAHSEVIKRK

SEQ ID NO: 251312 - protein, 21 aa, Homo sapiens
  Native (MAGC1_HUMAN)
PPRYEFLWGPRAHSEVIKRKV

SEQ ID NO: 251313 - protein, 22 aa, Homo sapiens
  Native (MAGC1_HUMAN)
PPRYEFLWGPRAHSEVIKRKVV

SEQ ID NO: 251314 - protein, 23 aa, Homo sapiens
  Native (MAGC1_HUMAN)
PPRYEFLWGPRAHSEVIKRKVVE

SEQ ID NO: 251315 - protein, 24 aa, Homo sapiens
  Native (MAGC1_HUMAN)
PPRYEFLWGPRAHSEVIKRKVVEF

SEQ ID NO: 251316 - protein, 25 aa, Homo sapiens
  Native (MAGC1_HUMAN)
PPRYEFLWGPRAHSEVIKRKVVEFL

SEQ ID NO: 251317 - protein, 19 aa, Homo sapiens
  Native (MAGC1_HUMAN)
PQFPPQGEDFQSSLQSPVS

SEQ ID NO: 251318 - protein, 20 aa, Homo sapiens
  Native (MAGC1_HUMAN)
PQFPPQGEDFQSSLQSPVSI

SEQ ID NO: 251319 - protein, 21 aa, Homo sapiens
  Native (MAGC1_HUMAN)
PQFPPQGEDFQSSLQSPVSIC

SEQ ID NO: 251320 - protein, 22 aa, Homo sapiens
  Native (MAGC1_HUMAN)
PQFPPQGEDFQSSLQSPVSICS

SEQ ID NO: 251321 - protein, 23 aa, Homo sapiens
  Native (MAGC1_HUMAN)
PQFPPQGEDFQSSLQSPVSICSS

SEQ ID NO: 251322 - protein, 24 aa, Homo sapiens
  Native (MAGC1_HUMAN)
PQFPPQGEDFQSSLQSPVSICSSS

SEQ ID NO: 251323 - protein, 25 aa, Homo sapiens
  Native (MAGC1_HUMAN)
PQFPPQGEDFQSSLQSPVSICSSST

SEQ ID NO: 251324 - protein, 14 aa, Homo sapiens
  Native (MAGC1_HUMAN)
PQGEDFQSSLQSPV

SEQ ID NO: 251325 - protein, 15 aa, Homo sapiens
  Native (MAGC1_HUMAN)
PQGEDFQSSLQSPVS

SEQ ID NO: 251326 - protein, 16 aa, Homo sapiens
  Native (MAGC1_HUMAN)
PQGEDFQSSLQSPVSI

SEQ ID NO: 251327 - protein, 17 aa, Homo sapiens
  Native (MAGC1_HUMAN)
PQGEDFQSSLQSPVSIC

SEQ ID NO: 251328 - protein, 19 aa, Homo sapiens
  Native (MAGC1_HUMAN)
PQGEDFQSSLQSPVSICSS

SEQ ID NO: 251329 - protein, 20 aa, Homo sapiens
  Native (MAGC1_HUMAN)
PQGEDFQSSLQSPVSICSSS

SEQ ID NO: 251330 - protein, 21 aa, Homo sapiens
  Native (MAGC1_HUMAN)
PQGEDFQSSLQSPVSICSSST

SEQ ID NO: 251331 - protein, 22 aa, Homo sapiens
  Native (MAGC1_HUMAN)
PQGEDFQSSLQSPVSICSSSTS

SEQ ID NO: 251332 - protein, 23 aa, Homo sapiens
  Native (MAGC1_HUMAN)
PQGEDFQSSLQSPVSICSSSTSL

SEQ ID NO: 251333 - protein, 24 aa, Homo sapiens
  Native (MAGC1_HUMAN)
PQGEDFQSSLQSPVSICSSSTSLS

SEQ ID NO: 251334 - protein, 25 aa, Homo sapiens
  Native (MAGC1_HUMAN)
PQGEDFQSSLQSPVSICSSSTSLSL

SEQ ID NO: 251335 - protein, 19 aa, Homo sapiens
  Native (MAGC1_HUMAN)
PQGEDSMSPLYFPQSPLQG

SEQ ID NO: 251336 - protein, 20 aa, Homo sapiens
  Native (MAGC1_HUMAN)
PQGEDSMSPLYFPQSPLQGE

SEQ ID NO: 251337 - protein, 21 aa, Homo sapiens
  Native (MAGC1_HUMAN)
PQGEDSMSPLYFPQSPLQGEE

SEQ ID NO: 251338 - protein, 22 aa, Homo sapiens
  Native (MAGC1_HUMAN)
PQGEDSMSPLYFPQSPLQGEEF

SEQ ID NO: 251339 - protein, 23 aa, Homo sapiens
  Native (MAGC1_HUMAN)
PQGEDSMSPLYFPQSPLQGEEFQ

SEQ ID NO: 251340 - protein, 24 aa, Homo sapiens
  Native (MAGC1_HUMAN)
PQGEDSMSPLYFPQSPLQGEEFQS

SEQ ID NO: 251341 - protein, 25 aa, Homo sapiens
  Native (MAGC1_HUMAN)
PQGEDSMSPLYFPQSPLQGEEFQSS

SEQ ID NO: 251342 - protein, 14 aa, Homo sapiens
  Native (MAGC1_HUMAN)
PQSLLQIPMTSSFS

SEQ ID NO: 251343 - protein, 15 aa, Homo sapiens
  Native (MAGC1_HUMAN)
PQSLLQIPMTSSFSS

SEQ ID NO: 251344 - protein, 16 aa, Homo sapiens
  Native (MAGC1_HUMAN)
PQSLLQIPMTSSFSST

SEQ ID NO: 251345 - protein, 17 aa, Homo sapiens
  Native (MAGC1_HUMAN)
PQSLLQIPMTSSFSSTL

SEQ ID NO: 251346 - protein, 18 aa, Homo sapiens
  Native (MAGC1_HUMAN)
PQSLLQIPMTSSFSSTLL

SEQ ID NO: 251347 - protein, 19 aa, Homo sapiens
  Native (MAGC1_HUMAN)
PQSLLQIPMTSSFSSTLLS

SEQ ID NO: 251348 - protein, 20 aa, Homo sapiens
  Native (MAGC1_HUMAN)
PQSLLQIPMTSSFSSTLLSI

SEQ ID NO: 251349 - protein, 21 aa, Homo sapiens
  Native (MAGC1_HUMAN)
PQSLLQIPMTSSFSSTLLSIF

SEQ ID NO: 251350 - protein, 22 aa, Homo sapiens
  Native (MAGC1_HUMAN)
PQSLLQIPMTSSFSSTLLSIFQ

SEQ ID NO: 251351 - protein, 23 aa, Homo sapiens
  Native (MAGC1_HUMAN)
PQSLLQIPMTSSFSSTLLSIFQS

SEQ ID NO: 251352 - protein, 24 aa, Homo sapiens
  Native (MAGC1_HUMAN)
PQSLLQIPMTSSFSSTLLSIFQSS

SEQ ID NO: 251353 - protein, 25 aa, Homo sapiens
  Native (MAGC1_HUMAN)
PQSLLQIPMTSSFSSTLLSIFQSSP

SEQ ID NO: 251354 - protein, 15 aa, Homo sapiens
  Native (MAGC1_HUMAN)
PQSPLEGEDSLSSLH

SEQ ID NO: 251355 - protein, 19 aa, Homo sapiens
  Native (MAGC1_HUMAN)
PQSPLEGEDSLSSLHFPQS

SEQ ID NO: 251356 - protein, 20 aa, Homo sapiens
  Native (MAGC1_HUMAN)
PQSPLEGEDSLSSLHFPQSP

SEQ ID NO: 251357 - protein, 21 aa, Homo sapiens
  Native (MAGC1_HUMAN)
PQSPLEGEDSLSSLHFPQSPP

SEQ ID NO: 251358 - protein, 22 aa, Homo sapiens
  Native (MAGC1_HUMAN)
PQSPLEGEDSLSSLHFPQSPPE

SEQ ID NO: 251359 - protein, 23 aa, Homo sapiens
  Native (MAGC1_HUMAN)
PQSPLEGEDSLSSLHFPQSPPEW

SEQ ID NO: 251360 - protein, 24 aa, Homo sapiens
  Native (MAGC1_HUMAN)
PQSPLEGEDSLSSLHFPQSPPEWE

SEQ ID NO: 251361 - protein, 25 aa, Homo sapiens
  Native (MAGC1_HUMAN)
PQSPLEGEDSLSSLHFPQSPPEWED

SEQ ID NO: 251362 - protein, 13 aa, Homo sapiens
  Native (MAGC1_HUMAN)
PQSPLQGEEFQSS

SEQ ID NO: 251363 - protein, 14 aa, Homo sapiens
  Native (MAGC1_HUMAN)
PQSPLQGEEFQSSL

SEQ ID NO: 251364 - protein, 15 aa, Homo sapiens
  Native (MAGC1_HUMAN)
PQSPLQGEEFQSSLQ

SEQ ID NO: 251365 - protein, 16 aa, Homo sapiens
  Native (MAGC1_HUMAN)
PQSPLQGEEFQSSLQS

SEQ ID NO: 251366 - protein, 17 aa, Homo sapiens
  Native (MAGC1_HUMAN)
PQSPLQGEEFQSSLQSP

SEQ ID NO: 251367 - protein, 18 aa, Homo sapiens
  Native (MAGC1_HUMAN)
PQSPLQGEEFQSSLQSPV

SEQ ID NO: 251368 - protein, 19 aa, Homo sapiens
  Native (MAGC1_HUMAN)
PQSPLQGEEFQSSLQSPVS

SEQ ID NO: 251369 - protein, 20 aa, Homo sapiens
  Native (MAGC1_HUMAN)
PQSPLQGEEFQSSLQSPVSI

SEQ ID NO: 251370 - protein, 21 aa, Homo sapiens
  Native (MAGC1_HUMAN)
PQSPLQGEEFQSSLQSPVSIC

SEQ ID NO: 251371 - protein, 22 aa, Homo sapiens
  Native (MAGC1_HUMAN)
PQSPLQGEEFQSSLQSPVSICS

SEQ ID NO: 251372 - protein, 23 aa, Homo sapiens
  Native (MAGC1_HUMAN)
PQSPLQGEEFQSSLQSPVSICSS

SEQ ID NO: 251373 - protein, 24 aa, Homo sapiens
  Native (MAGC1_HUMAN)
PQSPLQGEEFQSSLQSPVSICSSS

SEQ ID NO: 251374 - protein, 25 aa, Homo sapiens
  Native (MAGC1_HUMAN)
PQSPLQGEEFQSSLQSPVSICSSST

SEQ ID NO: 251375 - protein, 15 aa, Homo sapiens
  Native (MAGC1_HUMAN)
PQSPLQIPGSPSFSS

SEQ ID NO: 251376 - protein, 16 aa, Homo sapiens
  Native (MAGC1_HUMAN)
PQSPLQIPGSPSFSST

SEQ ID NO: 251377 - protein, 17 aa, Homo sapiens
  Native (MAGC1_HUMAN)
PQSPLQIPGSPSFSSTL

SEQ ID NO: 251378 - protein, 18 aa, Homo sapiens
  Native (MAGC1_HUMAN)
PQSPLQIPGSPSFSSTLL

SEQ ID NO: 251379 - protein, 19 aa, Homo sapiens
  Native (MAGC1_HUMAN)
PQSPLQIPGSPSFSSTLLS

SEQ ID NO: 251380 - protein, 20 aa, Homo sapiens
  Native (MAGC1_HUMAN)
PQSPLQIPGSPSFSSTLLSL

SEQ ID NO: 251381 - protein, 21 aa, Homo sapiens
  Native (MAGC1_HUMAN)
PQSPLQIPGSPSFSSTLLSLF

SEQ ID NO: 251382 - protein, 22 aa, Homo sapiens
  Native (MAGC1_HUMAN)
PQSPLQIPGSPSFSSTLLSLFQ

SEQ ID NO: 251383 - protein, 23 aa, Homo sapiens
  Native (MAGC1_HUMAN)
PQSPLQIPGSPSFSSTLLSLFQS

SEQ ID NO: 251384 - protein, 24 aa, Homo sapiens
  Native (MAGC1_HUMAN)
PQSPLQIPGSPSFSSTLLSLFQSS

SEQ ID NO: 251385 - protein, 25 aa, Homo sapiens
  Native (MAGC1_HUMAN)
PQSPLQIPGSPSFSSTLLSLFQSSP

SEQ ID NO: 251386 - protein, 15 aa, Homo sapiens
  Native (MAGC1_HUMAN)
PQSPLQIPMTSSFSS

SEQ ID NO: 251387 - protein, 16 aa, Homo sapiens
  Native (MAGC1_HUMAN)
PQSPLQIPMTSSFSST

SEQ ID NO: 251388 - protein, 17 aa, Homo sapiens
  Native (MAGC1_HUMAN)
PQSPLQIPMTSSFSSTL

SEQ ID NO: 251389 - protein, 18 aa, Homo sapiens
  Native (MAGC1_HUMAN)
PQSPLQIPMTSSFSSTLL

SEQ ID NO: 251390 - protein, 19 aa, Homo sapiens
  Native (MAGC1_HUMAN)
PQSPLQIPMTSSFSSTLLS

SEQ ID NO: 251391 - protein, 20 aa, Homo sapiens
  Native (MAGC1_HUMAN)
PQSPLQIPMTSSFSSTLLSI

SEQ ID NO: 251392 - protein, 21 aa, Homo sapiens
  Native (MAGC1_HUMAN)
PQSPLQIPMTSSFSSTLLSIL

SEQ ID NO: 251393 - protein, 22 aa, Homo sapiens
  Native (MAGC1_HUMAN)
PQSPLQIPMTSSFSSTLLSILQ

SEQ ID NO: 251394 - protein, 23 aa, Homo sapiens
  Native (MAGC1_HUMAN)
PQSPLQIPMTSSFSSTLLSILQS

SEQ ID NO: 251395 - protein, 24 aa, Homo sapiens
  Native (MAGC1_HUMAN)
PQSPLQIPMTSSFSSTLLSILQSS

SEQ ID NO: 251396 - protein, 25 aa, Homo sapiens
  Native (MAGC1_HUMAN)
PQSPLQIPMTSSFSSTLLSILQSSP

SEQ ID NO: 251397 - protein, 15 aa, Homo sapiens
  Native (MAGC1_HUMAN)
PQSPLQIPVSRSFSS

SEQ ID NO: 251398 - protein, 17 aa, Homo sapiens
  Native (MAGC1_HUMAN)
PQSPLQIPVSRSFSSTL

SEQ ID NO: 251399 - protein, 19 aa, Homo sapiens
  Native (MAGC1_HUMAN)
PQSPLQIPVSRSFSSTLLS

SEQ ID NO: 251400 - protein, 20 aa, Homo sapiens
  Native (MAGC1_HUMAN)
PQSPLQIPVSRSFSSTLLSI

SEQ ID NO: 251401 - protein, 21 aa, Homo sapiens
  Native (MAGC1_HUMAN)
PQSPLQIPVSRSFSSTLLSIF

SEQ ID NO: 251402 - protein, 22 aa, Homo sapiens
  Native (MAGC1_HUMAN)
PQSPLQIPVSRSFSSTLLSIFQ

SEQ ID NO: 251403 - protein, 23 aa, Homo sapiens
  Native (MAGC1_HUMAN)
PQSPLQIPVSRSFSSTLLSIFQS

SEQ ID NO: 251404 - protein, 24 aa, Homo sapiens
  Native (MAGC1_HUMAN)
PQSPLQIPVSRSFSSTLLSIFQSS

SEQ ID NO: 251405 - protein, 25 aa, Homo sapiens
  Native (MAGC1_HUMAN)
PQSPLQIPVSRSFSSTLLSIFQSSP

SEQ ID NO: 251406 - protein, 15 aa, Homo sapiens
  Native (MAGC1_HUMAN)
PQSPLQIPVSSSFSY

SEQ ID NO: 251407 - protein, 17 aa, Homo sapiens
  Native (MAGC1_HUMAN)
PQSPLQIPVSSSFSYTL

SEQ ID NO: 251408 - protein, 19 aa, Homo sapiens
  Native (MAGC1_HUMAN)
PQSPLQIPVSSSFSYTLLS

SEQ ID NO: 251409 - protein, 20 aa, Homo sapiens
  Native (MAGC1_HUMAN)
PQSPLQIPVSSSFSYTLLSL

SEQ ID NO: 251410 - protein, 21 aa, Homo sapiens
  Native (MAGC1_HUMAN)
PQSPLQIPVSSSFSYTLLSLF

SEQ ID NO: 251411 - protein, 22 aa, Homo sapiens
  Native (MAGC1_HUMAN)
PQSPLQIPVSSSFSYTLLSLFQ

SEQ ID NO: 251412 - protein, 23 aa, Homo sapiens
  Native (MAGC1_HUMAN)
PQSPLQIPVSSSFSYTLLSLFQS

SEQ ID NO: 251413 - protein, 24 aa, Homo sapiens
  Native (MAGC1_HUMAN)
PQSPLQIPVSSSFSYTLLSLFQSS

SEQ ID NO: 251414 - protein, 25 aa, Homo sapiens
  Native (MAGC1_HUMAN)
PQSPLQIPVSSSFSYTLLSLFQSSP

SEQ ID NO: 251415 - protein, 16 aa, Homo sapiens
  Native (MAGC1_HUMAN)
PQSPLQIPVSSSSSSS

SEQ ID NO: 251416 - protein, 17 aa, Homo sapiens
  Native (MAGC1_HUMAN)
PQSPLQIPVSSSSSSST

SEQ ID NO: 251417 - protein, 18 aa, Homo sapiens
  Native (MAGC1_HUMAN)
PQSPLQIPVSSSSSSSTL

SEQ ID NO: 251418 - protein, 19 aa, Homo sapiens
  Native (MAGC1_HUMAN)
PQSPLQIPVSSSSSSSTLL

SEQ ID NO: 251419 - protein, 20 aa, Homo sapiens
  Native (MAGC1_HUMAN)
PQSPLQIPVSSSSSSSTLLS

SEQ ID NO: 251420 - protein, 21 aa, Homo sapiens
  Native (MAGC1_HUMAN)
PQSPLQIPVSSSSSSSTLLSL

SEQ ID NO: 251421 - protein, 22 aa, Homo sapiens
  Native (MAGC1_HUMAN)
PQSPLQIPVSSSSSSSTLLSLF

SEQ ID NO: 251422 - protein, 23 aa, Homo sapiens
  Native (MAGC1_HUMAN)
PQSPLQIPVSSSSSSSTLLSLFQ

SEQ ID NO: 251423 - protein, 24 aa, Homo sapiens
  Native (MAGC1_HUMAN)
PQSPLQIPVSSSSSSSTLLSLFQS

SEQ ID NO: 251424 - protein, 25 aa, Homo sapiens
  Native (MAGC1_HUMAN)
PQSPLQIPVSSSSSSSTLLSLFQSS

SEQ ID NO: 251425 - protein, 16 aa, Homo sapiens
  Native (MAGC1_HUMAN)
PQSPLQIPVSSSSSST

SEQ ID NO: 251426 - protein, 17 aa, Homo sapiens
  Native (MAGC1_HUMAN)
PQSPLQIPVSSSSSSTL

SEQ ID NO: 251427 - protein, 18 aa, Homo sapiens
  Native (MAGC1_HUMAN)
PQSPLQIPVSSSSSSTLL

SEQ ID NO: 251428 - protein, 19 aa, Homo sapiens
  Native (MAGC1_HUMAN)
PQSPLQIPVSSSSSSTLLS

SEQ ID NO: 251429 - protein, 20 aa, Homo sapiens
  Native (MAGC1_HUMAN)
PQSPLQIPVSSSSSSTLLSL

SEQ ID NO: 251430 - protein, 21 aa, Homo sapiens
  Native (MAGC1_HUMAN)
PQSPLQIPVSSSSSSTLLSLF

SEQ ID NO: 251431 - protein, 22 aa, Homo sapiens
  Native (MAGC1_HUMAN)
PQSPLQIPVSSSSSSTLLSLFQ

SEQ ID NO: 251432 - protein, 23 aa, Homo sapiens
  Native (MAGC1_HUMAN)
PQSPLQIPVSSSSSSTLLSLFQS

SEQ ID NO: 251433 - protein, 24 aa, Homo sapiens
  Native (MAGC1_HUMAN)
PQSPLQIPVSSSSSSTLLSLFQSS

SEQ ID NO: 251434 - protein, 25 aa, Homo sapiens
  Native (MAGC1_HUMAN)
PQSPLQIPVSSSSSSTLLSLFQSSP

SEQ ID NO: 251435 - protein, 20 aa, Homo sapiens
  Native (MAGC1_HUMAN)
PQSPPEGENTHSPLQIVPSL

SEQ ID NO: 251436 - protein, 21 aa, Homo sapiens
  Native (MAGC1_HUMAN)
PQSPPEGENTHSPLQIVPSLP

SEQ ID NO: 251437 - protein, 22 aa, Homo sapiens
  Native (MAGC1_HUMAN)
PQSPPEGENTHSPLQIVPSLPE

SEQ ID NO: 251438 - protein, 23 aa, Homo sapiens
  Native (MAGC1_HUMAN)
PQSPPEGENTHSPLQIVPSLPEW

SEQ ID NO: 251439 - protein, 24 aa, Homo sapiens
  Native (MAGC1_HUMAN)
PQSPPEGENTHSPLQIVPSLPEWE

SEQ ID NO: 251440 - protein, 25 aa, Homo sapiens
  Native (MAGC1_HUMAN)
PQSPPEGENTHSPLQIVPSLPEWED

SEQ ID NO: 251441 - protein, 20 aa, Homo sapiens
  Native (MAGC1_HUMAN)
PQSPPEGMHSQSPLQSPESA

SEQ ID NO: 251442 - protein, 25 aa, Homo sapiens
  Native (MAGC1_HUMAN)
PQSPPEGPAQSPLQRPVSSFFSYTL

SEQ ID NO: 251443 - protein, 25 aa, Homo sapiens
  Native (MAGC1_HUMAN)
PQSPPEGPAQSPLQSPVSSFPSSTS

SEQ ID NO: 251444 - protein, 20 aa, Homo sapiens
  Native (MAGC1_HUMAN)
PQSPPEWEDSLSPLHFPQFP

SEQ ID NO: 251445 - protein, 21 aa, Homo sapiens
  Native (MAGC1_HUMAN)
PQSPPEWEDSLSPLHFPQFPP

SEQ ID NO: 251446 - protein, 22 aa, Homo sapiens
  Native (MAGC1_HUMAN)
PQSPPEWEDSLSPLHFPQFPPQ

SEQ ID NO: 251447 - protein, 23 aa, Homo sapiens
  Native (MAGC1_HUMAN)
PQSPPEWEDSLSPLHFPQFPPQG

SEQ ID NO: 251448 - protein, 24 aa, Homo sapiens
  Native (MAGC1_HUMAN)
PQSPPEWEDSLSPLHFPQFPPQGE

SEQ ID NO: 251449 - protein, 25 aa, Homo sapiens
  Native (MAGC1_HUMAN)
PQSPPEWEDSLSPLHFPQFPPQGED

SEQ ID NO: 251450 - protein, 23 aa, Homo sapiens
  Native (MAGC1_HUMAN)
PQSPPQGEDSMSPLYFPQSPLQG

SEQ ID NO: 251451 - protein, 24 aa, Homo sapiens
  Native (MAGC1_HUMAN)
PQSPPQGEDSMSPLYFPQSPLQGE

SEQ ID NO: 251452 - protein, 25 aa, Homo sapiens
  Native (MAGC1_HUMAN)
PQSPPQGEDSMSPLYFPQSPLQGEE

SEQ ID NO: 251453 - protein, 20 aa, Homo sapiens
  Native (MAGC1_HUMAN)
PQSSPESDDTLYPLQSPQSR

SEQ ID NO: 251454 - protein, 21 aa, Homo sapiens
  Native (MAGC1_HUMAN)
PQSSPESDDTLYPLQSPQSRS

SEQ ID NO: 251455 - protein, 22 aa, Homo sapiens
  Native (MAGC1_HUMAN)
PQSSPESDDTLYPLQSPQSRSE

SEQ ID NO: 251456 - protein, 23 aa, Homo sapiens
  Native (MAGC1_HUMAN)
PQSSPESDDTLYPLQSPQSRSEG

SEQ ID NO: 251457 - protein, 24 aa, Homo sapiens
  Native (MAGC1_HUMAN)
PQSSPESDDTLYPLQSPQSRSEGE

SEQ ID NO: 251458 - protein, 25 aa, Homo sapiens
  Native (MAGC1_HUMAN)
PQSSPESDDTLYPLQSPQSRSEGED

SEQ ID NO: 251459 - protein, 14 aa, Homo sapiens
  Native (MAGC1_HUMAN)
PQSVLQIPVSAASS

SEQ ID NO: 251460 - protein, 15 aa, Homo sapiens
  Native (MAGC1_HUMAN)
PQSVLQIPVSAASSS

SEQ ID NO: 251461 - protein, 16 aa, Homo sapiens
  Native (MAGC1_HUMAN)
PQSVLQIPVSAASSST

SEQ ID NO: 251462 - protein, 17 aa, Homo sapiens
  Native (MAGC1_HUMAN)
PQSVLQIPVSAASSSTL

SEQ ID NO: 251463 - protein, 18 aa, Homo sapiens
  Native (MAGC1_HUMAN)
PQSVLQIPVSAASSSTLV

SEQ ID NO: 251464 - protein, 19 aa, Homo sapiens
  Native (MAGC1_HUMAN)
PQSVLQIPVSAASSSTLVS

SEQ ID NO: 251465 - protein, 20 aa, Homo sapiens
  Native (MAGC1_HUMAN)
PQSVLQIPVSAASSSTLVSI

SEQ ID NO: 251466 - protein, 21 aa, Homo sapiens
  Native (MAGC1_HUMAN)
PQSVLQIPVSAASSSTLVSIF

SEQ ID NO: 251467 - protein, 22 aa, Homo sapiens
  Native (MAGC1_HUMAN)
PQSVLQIPVSAASSSTLVSIFQ

SEQ ID NO: 251468 - protein, 23 aa, Homo sapiens
  Native (MAGC1_HUMAN)
PQSVLQIPVSAASSSTLVSIFQS

SEQ ID NO: 251469 - protein, 24 aa, Homo sapiens
  Native (MAGC1_HUMAN)
PQSVLQIPVSAASSSTLVSIFQSS

SEQ ID NO: 251470 - protein, 25 aa, Homo sapiens
  Native (MAGC1_HUMAN)
PQSVLQIPVSAASSSTLVSIFQSSP

SEQ ID NO: 251471 - protein, 15 aa, Homo sapiens
  Native (MAGC1_HUMAN)
PRAHSEVIKRKVVEF

SEQ ID NO: 251472 - protein, 16 aa, Homo sapiens
  Native (MAGC1_HUMAN)
PRAHSEVIKRKVVEFL

SEQ ID NO: 251473 - protein, 17 aa, Homo sapiens
  Native (MAGC1_HUMAN)
PRAHSEVIKRKVVEFLA

SEQ ID NO: 251474 - protein, 18 aa, Homo sapiens
  Native (MAGC1_HUMAN)
PRAHSEVIKRKVVEFLAM

SEQ ID NO: 251475 - protein, 19 aa, Homo sapiens
  Native (MAGC1_HUMAN)
PRAHSEVIKRKVVEFLAML

SEQ ID NO: 251476 - protein, 20 aa, Homo sapiens
  Native (MAGC1_HUMAN)
PRAHSEVIKRKVVEFLAMLK

SEQ ID NO: 251477 - protein, 21 aa, Homo sapiens
  Native (MAGC1_HUMAN)
PRAHSEVIKRKVVEFLAMLKN

SEQ ID NO: 251478 - protein, 22 aa, Homo sapiens
  Native (MAGC1_HUMAN)
PRAHSEVIKRKVVEFLAMLKNT

SEQ ID NO: 251479 - protein, 23 aa, Homo sapiens
  Native (MAGC1_HUMAN)
PRAHSEVIKRKVVEFLAMLKNTV

SEQ ID NO: 251480 - protein, 24 aa, Homo sapiens
  Native (MAGC1_HUMAN)
PRAHSEVIKRKVVEFLAMLKNTVP

SEQ ID NO: 251481 - protein, 25 aa, Homo sapiens
  Native (MAGC1_HUMAN)
PRAHSEVIKRKVVEFLAMLKNTVPI

SEQ ID NO: 251482 - protein, 13 aa, Homo sapiens
  Native (MAGC1_HUMAN)
PRELLTKVWVQEH

SEQ ID NO: 251483 - protein, 14 aa, Homo sapiens
  Native (MAGC1_HUMAN)
PRELLTKVWVQEHY

SEQ ID NO: 251484 - protein, 15 aa, Homo sapiens
  Native (MAGC1_HUMAN)
PRELLTKVWVQEHYL

SEQ ID NO: 251485 - protein, 16 aa, Homo sapiens
  Native (MAGC1_HUMAN)
PRELLTKVWVQEHYLE

SEQ ID NO: 251486 - protein, 17 aa, Homo sapiens
  Native (MAGC1_HUMAN)
PRELLTKVWVQEHYLEY

SEQ ID NO: 251487 - protein, 18 aa, Homo sapiens
  Native (MAGC1_HUMAN)
PRELLTKVWVQEHYLEYR

SEQ ID NO: 251488 - protein, 19 aa, Homo sapiens
  Native (MAGC1_HUMAN)
PRELLTKVWVQEHYLEYRE

SEQ ID NO: 251489 - protein, 20 aa, Homo sapiens
  Native (MAGC1_HUMAN)
PRELLTKVWVQEHYLEYREV

SEQ ID NO: 251490 - protein, 21 aa, Homo sapiens
  Native (MAGC1_HUMAN)
PRELLTKVWVQEHYLEYREVP

SEQ ID NO: 251491 - protein, 22 aa, Homo sapiens
  Native (MAGC1_HUMAN)
PRELLTKVWVQEHYLEYREVPN

SEQ ID NO: 251492 - protein, 23 aa, Homo sapiens
  Native (MAGC1_HUMAN)
PRELLTKVWVQEHYLEYREVPNS

SEQ ID NO: 251493 - protein, 24 aa, Homo sapiens
  Native (MAGC1_HUMAN)
PRELLTKVWVQEHYLEYREVPNSS

SEQ ID NO: 251494 - protein, 25 aa, Homo sapiens
  Native (MAGC1_HUMAN)
PRELLTKVWVQEHYLEYREVPNSSP

SEQ ID NO: 251495 - protein, 13 aa, Homo sapiens
  Native (MAGC1_HUMAN)
PRYEFLWGPRAHS

SEQ ID NO: 251496 - protein, 14 aa, Homo sapiens
  Native (MAGC1_HUMAN)
PRYEFLWGPRAHSE

SEQ ID NO: 251497 - protein, 15 aa, Homo sapiens
  Native (MAGC1_HUMAN)
PRYEFLWGPRAHSEV

SEQ ID NO: 251498 - protein, 16 aa, Homo sapiens
  Native (MAGC1_HUMAN)
PRYEFLWGPRAHSEVI

SEQ ID NO: 251499 - protein, 17 aa, Homo sapiens
  Native (MAGC1_HUMAN)
PRYEFLWGPRAHSEVIK

SEQ ID NO: 251500 - protein, 18 aa, Homo sapiens
  Native (MAGC1_HUMAN)
PRYEFLWGPRAHSEVIKR

SEQ ID NO: 251501 - protein, 19 aa, Homo sapiens
  Native (MAGC1_HUMAN)
PRYEFLWGPRAHSEVIKRK

SEQ ID NO: 251502 - protein, 20 aa, Homo sapiens
  Native (MAGC1_HUMAN)
PRYEFLWGPRAHSEVIKRKV

SEQ ID NO: 251503 - protein, 21 aa, Homo sapiens
  Native (MAGC1_HUMAN)
PRYEFLWGPRAHSEVIKRKVV

SEQ ID NO: 251504 - protein, 22 aa, Homo sapiens
  Native (MAGC1_HUMAN)
PRYEFLWGPRAHSEVIKRKVVE

SEQ ID NO: 251505 - protein, 23 aa, Homo sapiens
  Native (MAGC1_HUMAN)
PRYEFLWGPRAHSEVIKRKVVEF

SEQ ID NO: 251506 - protein, 24 aa, Homo sapiens
  Native (MAGC1_HUMAN)
PRYEFLWGPRAHSEVIKRKVVEFL

SEQ ID NO: 251507 - protein, 25 aa, Homo sapiens
  Native (MAGC1_HUMAN)
PRYEFLWGPRAHSEVIKRKVVEFLA

SEQ ID NO: 251508 - protein, 13 aa, Homo sapiens
  Native (MAGC1_HUMAN)
PSFSSTLLSLFQS

SEQ ID NO: 251509 - protein, 14 aa, Homo sapiens
  Native (MAGC1_HUMAN)
PSFSSTLLSLFQSS

SEQ ID NO: 251510 - protein, 15 aa, Homo sapiens
  Native (MAGC1_HUMAN)
PSFSSTLLSLFQSSP

SEQ ID NO: 251511 - protein, 16 aa, Homo sapiens
  Native (MAGC1_HUMAN)
PSFSSTLLSLFQSSPE

SEQ ID NO: 251512 - protein, 17 aa, Homo sapiens
  Native (MAGC1_HUMAN)
PSFSSTLLSLFQSSPER

SEQ ID NO: 251513 - protein, 18 aa, Homo sapiens
  Native (MAGC1_HUMAN)
PSFSSTLLSLFQSSPERT

SEQ ID NO: 251514 - protein, 19 aa, Homo sapiens
  Native (MAGC1_HUMAN)
PSFSSTLLSLFQSSPERTH

SEQ ID NO: 251515 - protein, 20 aa, Homo sapiens
  Native (MAGC1_HUMAN)
PSFSSTLLSLFQSSPERTHS

SEQ ID NO: 251516 - protein, 21 aa, Homo sapiens
  Native (MAGC1_HUMAN)
PSFSSTLLSLFQSSPERTHST

SEQ ID NO: 251517 - protein, 22 aa, Homo sapiens
  Native (MAGC1_HUMAN)
PSFSSTLLSLFQSSPERTHSTF

SEQ ID NO: 251518 - protein, 23 aa, Homo sapiens
  Native (MAGC1_HUMAN)
PSFSSTLLSLFQSSPERTHSTFE

SEQ ID NO: 251519 - protein, 24 aa, Homo sapiens
  Native (MAGC1_HUMAN)
PSFSSTLLSLFQSSPERTHSTFEG

SEQ ID NO: 251520 - protein, 25 aa, Homo sapiens
  Native (MAGC1_HUMAN)
PSFSSTLLSLFQSSPERTHSTFEGF

SEQ ID NO: 251521 - protein, 13 aa, Homo sapiens
  Native (MAGC1_HUMAN)
PSFSSTLVSLFQS

SEQ ID NO: 251522 - protein, 14 aa, Homo sapiens
  Native (MAGC1_HUMAN)
PSFSSTLVSLFQSS

SEQ ID NO: 251523 - protein, 15 aa, Homo sapiens
  Native (MAGC1_HUMAN)
PSFSSTLVSLFQSSP

SEQ ID NO: 251524 - protein, 16 aa, Homo sapiens
  Native (MAGC1_HUMAN)
PSFSSTLVSLFQSSPE

SEQ ID NO: 251525 - protein, 17 aa, Homo sapiens
  Native (MAGC1_HUMAN)
PSFSSTLVSLFQSSPER

SEQ ID NO: 251526 - protein, 18 aa, Homo sapiens
  Native (MAGC1_HUMAN)
PSFSSTLVSLFQSSPERT

SEQ ID NO: 251527 - protein, 19 aa, Homo sapiens
  Native (MAGC1_HUMAN)
PSFSSTLVSLFQSSPERTQ

SEQ ID NO: 251528 - protein, 20 aa, Homo sapiens
  Native (MAGC1_HUMAN)
PSFSSTLVSLFQSSPERTQS

SEQ ID NO: 251529 - protein, 21 aa, Homo sapiens
  Native (MAGC1_HUMAN)
PSFSSTLVSLFQSSPERTQST

SEQ ID NO: 251530 - protein, 22 aa, Homo sapiens
  Native (MAGC1_HUMAN)
PSFSSTLVSLFQSSPERTQSTF

SEQ ID NO: 251531 - protein, 23 aa, Homo sapiens
  Native (MAGC1_HUMAN)
PSFSSTLVSLFQSSPERTQSTFE

SEQ ID NO: 251532 - protein, 24 aa, Homo sapiens
  Native (MAGC1_HUMAN)
PSFSSTLVSLFQSSPERTQSTFEG

SEQ ID NO: 251533 - protein, 25 aa, Homo sapiens
  Native (MAGC1_HUMAN)
PSFSSTLVSLFQSSPERTQSTFEGF

SEQ ID NO: 251534 - protein, 14 aa, Homo sapiens
  Native (MAGC1_HUMAN)
PSSSSTLLSLFQSF

SEQ ID NO: 251535 - protein, 15 aa, Homo sapiens
  Native (MAGC1_HUMAN)
PSSSSTLLSLFQSFS

SEQ ID NO: 251536 - protein, 16 aa, Homo sapiens
  Native (MAGC1_HUMAN)
PSSSSTLLSLFQSFSE

SEQ ID NO: 251537 - protein, 17 aa, Homo sapiens
  Native (MAGC1_HUMAN)
PSSSSTLLSLFQSFSER

SEQ ID NO: 251538 - protein, 18 aa, Homo sapiens
  Native (MAGC1_HUMAN)
PSSSSTLLSLFQSFSERT

SEQ ID NO: 251539 - protein, 19 aa, Homo sapiens
  Native (MAGC1_HUMAN)
PSSSSTLLSLFQSFSERTQ

SEQ ID NO: 251540 - protein, 20 aa, Homo sapiens
  Native (MAGC1_HUMAN)
PSSSSTLLSLFQSFSERTQS

SEQ ID NO: 251541 - protein, 21 aa, Homo sapiens
  Native (MAGC1_HUMAN)
PSSSSTLLSLFQSFSERTQST

SEQ ID NO: 251542 - protein, 22 aa, Homo sapiens
  Native (MAGC1_HUMAN)
PSSSSTLLSLFQSFSERTQSTF

SEQ ID NO: 251543 - protein, 23 aa, Homo sapiens
  Native (MAGC1_HUMAN)
PSSSSTLLSLFQSFSERTQSTFE

SEQ ID NO: 251544 - protein, 24 aa, Homo sapiens
  Native (MAGC1_HUMAN)
PSSSSTLLSLFQSFSERTQSTFEG

SEQ ID NO: 251545 - protein, 25 aa, Homo sapiens
  Native (MAGC1_HUMAN)
PSSSSTLLSLFQSFSERTQSTFEGF

SEQ ID NO: 251546 - protein, 14 aa, Homo sapiens
  Native (MAGC1_HUMAN)
PSSTSSSLSKSSPE

SEQ ID NO: 251547 - protein, 15 aa, Homo sapiens
  Native (MAGC1_HUMAN)
PSSTSSSLSKSSPES

SEQ ID NO: 251548 - protein, 16 aa, Homo sapiens
  Native (MAGC1_HUMAN)
PSSTSSSLSKSSPESP

SEQ ID NO: 251549 - protein, 17 aa, Homo sapiens
  Native (MAGC1_HUMAN)
PSSTSSSLSKSSPESPL

SEQ ID NO: 251550 - protein, 19 aa, Homo sapiens
  Native (MAGC1_HUMAN)
PSSTSSSLSKSSPESPLQS

SEQ ID NO: 251551 - protein, 20 aa, Homo sapiens
  Native (MAGC1_HUMAN)
PSSTSSSLSKSSPESPLQSP

SEQ ID NO: 251552 - protein, 13 aa, Homo sapiens
  Native (MAGC1_HUMAN)
PSSTSSSLSQSSP

SEQ ID NO: 251553 - protein, 14 aa, Homo sapiens
  Native (MAGC1_HUMAN)
PSSTSSSLSQSSPV

SEQ ID NO: 251554 - protein, 15 aa, Homo sapiens
  Native (MAGC1_HUMAN)
PSSTSSSLSQSSPVS

SEQ ID NO: 251555 - protein, 16 aa, Homo sapiens
  Native (MAGC1_HUMAN)
PSSTSSSLSQSSPVSS

SEQ ID NO: 251556 - protein, 17 aa, Homo sapiens
  Native (MAGC1_HUMAN)
PSSTSSSLSQSSPVSSF

SEQ ID NO: 251557 - protein, 18 aa, Homo sapiens
  Native (MAGC1_HUMAN)
PSSTSSSLSQSSPVSSFP

SEQ ID NO: 251558 - protein, 19 aa, Homo sapiens
  Native (MAGC1_HUMAN)
PSSTSSSLSQSSPVSSFPS

SEQ ID NO: 251559 - protein, 20 aa, Homo sapiens
  Native (MAGC1_HUMAN)
PSSTSSSLSQSSPVSSFPSS

SEQ ID NO: 251560 - protein, 21 aa, Homo sapiens
  Native (MAGC1_HUMAN)
PSSTSSSLSQSSPVSSFPSST

SEQ ID NO: 251561 - protein, 22 aa, Homo sapiens
  Native (MAGC1_HUMAN)
PSSTSSSLSQSSPVSSFPSSTS

SEQ ID NO: 251562 - protein, 23 aa, Homo sapiens
  Native (MAGC1_HUMAN)
PSSTSSSLSQSSPVSSFPSSTSS

SEQ ID NO: 251563 - protein, 24 aa, Homo sapiens
  Native (MAGC1_HUMAN)
PSSTSSSLSQSSPVSSFPSSTSSS

SEQ ID NO: 251564 - protein, 25 aa, Homo sapiens
  Native (MAGC1_HUMAN)
PSSTSSSLSQSSPVSSFPSSTSSSL

SEQ ID NO: 251565 - protein, 13 aa, Homo sapiens
  Native (MAGC1_HUMAN)
PTAGMPSLLQSSS

SEQ ID NO: 251566 - protein, 14 aa, Homo sapiens
  Native (MAGC1_HUMAN)
PTAGMPSLLQSSSE

SEQ ID NO: 251567 - protein, 15 aa, Homo sapiens
  Native (MAGC1_HUMAN)
PTAGMPSLLQSSSES

SEQ ID NO: 251568 - protein, 16 aa, Homo sapiens
  Native (MAGC1_HUMAN)
PTAGMPSLLQSSSESP

SEQ ID NO: 251569 - protein, 17 aa, Homo sapiens
  Native (MAGC1_HUMAN)
PTAGMPSLLQSSSESPQ

SEQ ID NO: 251570 - protein, 18 aa, Homo sapiens
  Native (MAGC1_HUMAN)
PTAGMPSLLQSSSESPQS

SEQ ID NO: 251571 - protein, 19 aa, Homo sapiens
  Native (MAGC1_HUMAN)
PTAGMPSLLQSSSESPQSC

SEQ ID NO: 251572 - protein, 20 aa, Homo sapiens
  Native (MAGC1_HUMAN)
PTAGMPSLLQSSSESPQSCP

SEQ ID NO: 251573 - protein, 24 aa, Homo sapiens
  Native (MAGC1_HUMAN)
PTAGMPSLLQSSSESPQSCPEGED

SEQ ID NO: 251574 - protein, 25 aa, Homo sapiens
  Native (MAGC1_HUMAN)
PTAGMPSLLQSSSESPQSCPEGEDS

SEQ ID NO: 251575 - protein, 15 aa, Homo sapiens
  Native (MAGC1_HUMAN)
PVDEYTSSSDTLLES

SEQ ID NO: 251576 - protein, 16 aa, Homo sapiens
  Native (MAGC1_HUMAN)
PVDEYTSSSDTLLESD

SEQ ID NO: 251577 - protein, 17 aa, Homo sapiens
  Native (MAGC1_HUMAN)
PVDEYTSSSDTLLESDS

SEQ ID NO: 251578 - protein, 19 aa, Homo sapiens
  Native (MAGC1_HUMAN)
PVDEYTSSSDTLLESDSLT

SEQ ID NO: 251579 - protein, 20 aa, Homo sapiens
  Native (MAGC1_HUMAN)
PVDEYTSSSDTLLESDSLTD

SEQ ID NO: 251580 - protein, 21 aa, Homo sapiens
  Native (MAGC1_HUMAN)
PVDEYTSSSDTLLESDSLTDS

SEQ ID NO: 251581 - protein, 22 aa, Homo sapiens
  Native (MAGC1_HUMAN)
PVDEYTSSSDTLLESDSLTDSE

SEQ ID NO: 251582 - protein, 23 aa, Homo sapiens
  Native (MAGC1_HUMAN)
PVDEYTSSSDTLLESDSLTDSES

SEQ ID NO: 251583 - protein, 24 aa, Homo sapiens
  Native (MAGC1_HUMAN)
PVDEYTSSSDTLLESDSLTDSESL

SEQ ID NO: 251584 - protein, 25 aa, Homo sapiens
  Native (MAGC1_HUMAN)
PVDEYTSSSDTLLESDSLTDSESLI

SEQ ID NO: 251585 - protein, 13 aa, Homo sapiens
  Native (MAGC1_HUMAN)
PVIFRKAREFIEI

SEQ ID NO: 251586 - protein, 14 aa, Homo sapiens
  Native (MAGC1_HUMAN)
PVIFRKAREFIEIL

SEQ ID NO: 251587 - protein, 15 aa, Homo sapiens
  Native (MAGC1_HUMAN)
PVIFRKAREFIEILF

SEQ ID NO: 251588 - protein, 16 aa, Homo sapiens
  Native (MAGC1_HUMAN)
PVIFRKAREFIEILFG

SEQ ID NO: 251589 - protein, 17 aa, Homo sapiens
  Native (MAGC1_HUMAN)
PVIFRKAREFIEILFGI

SEQ ID NO: 251590 - protein, 18 aa, Homo sapiens
  Native (MAGC1_HUMAN)
PVIFRKAREFIEILFGIS

SEQ ID NO: 251591 - protein, 19 aa, Homo sapiens
  Native (MAGC1_HUMAN)
PVIFRKAREFIEILFGISL

SEQ ID NO: 251592 - protein, 20 aa, Homo sapiens
  Native (MAGC1_HUMAN)
PVIFRKAREFIEILFGISLR

SEQ ID NO: 251593 - protein, 21 aa, Homo sapiens
  Native (MAGC1_HUMAN)
PVIFRKAREFIEILFGISLRE

SEQ ID NO: 251594 - protein, 22 aa, Homo sapiens
  Native (MAGC1_HUMAN)
PVIFRKAREFIEILFGISLREV

SEQ ID NO: 251595 - protein, 23 aa, Homo sapiens
  Native (MAGC1_HUMAN)
PVIFRKAREFIEILFGISLREVD

SEQ ID NO: 251596 - protein, 24 aa, Homo sapiens
  Native (MAGC1_HUMAN)
PVIFRKAREFIEILFGISLREVDP

SEQ ID NO: 251597 - protein, 25 aa, Homo sapiens
  Native (MAGC1_HUMAN)
PVIFRKAREFIEILFGISLREVDPD

SEQ ID NO: 251598 - protein, 13 aa, Homo sapiens
  Native (MAGC1_HUMAN)
PVISFSSSTSLSP

SEQ ID NO: 251599 - protein, 14 aa, Homo sapiens
  Native (MAGC1_HUMAN)
PVISFSSSTSLSPF

SEQ ID NO: 251600 - protein, 15 aa, Homo sapiens
  Native (MAGC1_HUMAN)
PVISFSSSTSLSPFS

SEQ ID NO: 251601 - protein, 16 aa, Homo sapiens
  Native (MAGC1_HUMAN)
PVISFSSSTSLSPFSE

SEQ ID NO: 251602 - protein, 17 aa, Homo sapiens
  Native (MAGC1_HUMAN)
PVISFSSSTSLSPFSEE

SEQ ID NO: 251603 - protein, 18 aa, Homo sapiens
  Native (MAGC1_HUMAN)
PVISFSSSTSLSPFSEES

SEQ ID NO: 251604 - protein, 19 aa, Homo sapiens
  Native (MAGC1_HUMAN)
PVISFSSSTSLSPFSEESS

SEQ ID NO: 251605 - protein, 20 aa, Homo sapiens
  Native (MAGC1_HUMAN)
PVISFSSSTSLSPFSEESSS

SEQ ID NO: 251606 - protein, 21 aa, Homo sapiens
  Native (MAGC1_HUMAN)
PVISFSSSTSLSPFSEESSSP

SEQ ID NO: 251607 - protein, 22 aa, Homo sapiens
  Native (MAGC1_HUMAN)
PVISFSSSTSLSPFSEESSSPV

SEQ ID NO: 251608 - protein, 23 aa, Homo sapiens
  Native (MAGC1_HUMAN)
PVISFSSSTSLSPFSEESSSPVD

SEQ ID NO: 251609 - protein, 24 aa, Homo sapiens
  Native (MAGC1_HUMAN)
PVISFSSSTSLSPFSEESSSPVDE

SEQ ID NO: 251610 - protein, 25 aa, Homo sapiens
  Native (MAGC1_HUMAN)
PVISFSSSTSLSPFSEESSSPVDEY

SEQ ID NO: 251611 - protein, 13 aa, Homo sapiens
  Native (MAGC1_HUMAN)
PVSAASSSTLVSI

SEQ ID NO: 251612 - protein, 14 aa, Homo sapiens
  Native (MAGC1_HUMAN)
PVSAASSSTLVSIF

SEQ ID NO: 251613 - protein, 15 aa, Homo sapiens
  Native (MAGC1_HUMAN)
PVSAASSSTLVSIFQ

SEQ ID NO: 251614 - protein, 16 aa, Homo sapiens
  Native (MAGC1_HUMAN)
PVSAASSSTLVSIFQS

SEQ ID NO: 251615 - protein, 17 aa, Homo sapiens
  Native (MAGC1_HUMAN)
PVSAASSSTLVSIFQSS

SEQ ID NO: 251616 - protein, 18 aa, Homo sapiens
  Native (MAGC1_HUMAN)
PVSAASSSTLVSIFQSSP

SEQ ID NO: 251617 - protein, 19 aa, Homo sapiens
  Native (MAGC1_HUMAN)
PVSAASSSTLVSIFQSSPE

SEQ ID NO: 251618 - protein, 20 aa, Homo sapiens
  Native (MAGC1_HUMAN)
PVSAASSSTLVSIFQSSPES

SEQ ID NO: 251619 - protein, 21 aa, Homo sapiens
  Native (MAGC1_HUMAN)
PVSAASSSTLVSIFQSSPEST

SEQ ID NO: 251620 - protein, 22 aa, Homo sapiens
  Native (MAGC1_HUMAN)
PVSAASSSTLVSIFQSSPESTQ

SEQ ID NO: 251621 - protein, 23 aa, Homo sapiens
  Native (MAGC1_HUMAN)
PVSAASSSTLVSIFQSSPESTQS

SEQ ID NO: 251622 - protein, 24 aa, Homo sapiens
  Native (MAGC1_HUMAN)
PVSAASSSTLVSIFQSSPESTQSP

SEQ ID NO: 251623 - protein, 25 aa, Homo sapiens
  Native (MAGC1_HUMAN)
PVSAASSSTLVSIFQSSPESTQSPF

SEQ ID NO: 251624 - protein, 13 aa, Homo sapiens
  Native (MAGC1_HUMAN)
PVSICSSSTPSSL

SEQ ID NO: 251625 - protein, 14 aa, Homo sapiens
  Native (MAGC1_HUMAN)
PVSICSSSTPSSLP

SEQ ID NO: 251626 - protein, 15 aa, Homo sapiens
  Native (MAGC1_HUMAN)
PVSICSSSTPSSLPQ

SEQ ID NO: 251627 - protein, 16 aa, Homo sapiens
  Native (MAGC1_HUMAN)
PVSICSSSTPSSLPQS

SEQ ID NO: 251628 - protein, 17 aa, Homo sapiens
  Native (MAGC1_HUMAN)
PVSICSSSTPSSLPQSF

SEQ ID NO: 251629 - protein, 18 aa, Homo sapiens
  Native (MAGC1_HUMAN)
PVSICSSSTPSSLPQSFP

SEQ ID NO: 251630 - protein, 19 aa, Homo sapiens
  Native (MAGC1_HUMAN)
PVSICSSSTPSSLPQSFPE

SEQ ID NO: 251631 - protein, 20 aa, Homo sapiens
  Native (MAGC1_HUMAN)
PVSICSSSTPSSLPQSFPES

SEQ ID NO: 251632 - protein, 21 aa, Homo sapiens
  Native (MAGC1_HUMAN)
PVSICSSSTPSSLPQSFPESS

SEQ ID NO: 251633 - protein, 22 aa, Homo sapiens
  Native (MAGC1_HUMAN)
PVSICSSSTPSSLPQSFPESSQ

SEQ ID NO: 251634 - protein, 23 aa, Homo sapiens
  Native (MAGC1_HUMAN)
PVSICSSSTPSSLPQSFPESSQS

SEQ ID NO: 251635 - protein, 24 aa, Homo sapiens
  Native (MAGC1_HUMAN)
PVSICSSSTPSSLPQSFPESSQSP

SEQ ID NO: 251636 - protein, 25 aa, Homo sapiens
  Native (MAGC1_HUMAN)
PVSICSSSTPSSLPQSFPESSQSPP

SEQ ID NO: 251637 - protein, 13 aa, Homo sapiens
  Native (MAGC1_HUMAN)
PVSICSSSTSLSL

SEQ ID NO: 251638 - protein, 14 aa, Homo sapiens
  Native (MAGC1_HUMAN)
PVSICSSSTSLSLP

SEQ ID NO: 251639 - protein, 15 aa, Homo sapiens
  Native (MAGC1_HUMAN)
PVSICSSSTSLSLPQ

SEQ ID NO: 251640 - protein, 16 aa, Homo sapiens
  Native (MAGC1_HUMAN)
PVSICSSSTSLSLPQS

SEQ ID NO: 251641 - protein, 17 aa, Homo sapiens
  Native (MAGC1_HUMAN)
PVSICSSSTSLSLPQSF

SEQ ID NO: 251642 - protein, 18 aa, Homo sapiens
  Native (MAGC1_HUMAN)
PVSICSSSTSLSLPQSFP

SEQ ID NO: 251643 - protein, 19 aa, Homo sapiens
  Native (MAGC1_HUMAN)
PVSICSSSTSLSLPQSFPE

SEQ ID NO: 251644 - protein, 20 aa, Homo sapiens
  Native (MAGC1_HUMAN)
PVSICSSSTSLSLPQSFPES

SEQ ID NO: 251645 - protein, 21 aa, Homo sapiens
  Native (MAGC1_HUMAN)
PVSICSSSTSLSLPQSFPESP

SEQ ID NO: 251646 - protein, 22 aa, Homo sapiens
  Native (MAGC1_HUMAN)
PVSICSSSTSLSLPQSFPESPQ

SEQ ID NO: 251647 - protein, 23 aa, Homo sapiens
  Native (MAGC1_HUMAN)
PVSICSSSTSLSLPQSFPESPQS

SEQ ID NO: 251648 - protein, 24 aa, Homo sapiens
  Native (MAGC1_HUMAN)
PVSICSSSTSLSLPQSFPESPQSP

SEQ ID NO: 251649 - protein, 25 aa, Homo sapiens
  Native (MAGC1_HUMAN)
PVSICSSSTSLSLPQSFPESPQSPP

SEQ ID NO: 251650 - protein, 13 aa, Homo sapiens
  Native (MAGC1_HUMAN)
PVSPSFSSTLVSL

SEQ ID NO: 251651 - protein, 14 aa, Homo sapiens
  Native (MAGC1_HUMAN)
PVSPSFSSTLVSLF

SEQ ID NO: 251652 - protein, 15 aa, Homo sapiens
  Native (MAGC1_HUMAN)
PVSPSFSSTLVSLFQ

SEQ ID NO: 251653 - protein, 16 aa, Homo sapiens
  Native (MAGC1_HUMAN)
PVSPSFSSTLVSLFQS

SEQ ID NO: 251654 - protein, 17 aa, Homo sapiens
  Native (MAGC1_HUMAN)
PVSPSFSSTLVSLFQSS

SEQ ID NO: 251655 - protein, 18 aa, Homo sapiens
  Native (MAGC1_HUMAN)
PVSPSFSSTLVSLFQSSP

SEQ ID NO: 251656 - protein, 19 aa, Homo sapiens
  Native (MAGC1_HUMAN)
PVSPSFSSTLVSLFQSSPE

SEQ ID NO: 251657 - protein, 20 aa, Homo sapiens
  Native (MAGC1_HUMAN)
PVSPSFSSTLVSLFQSSPER

SEQ ID NO: 251658 - protein, 21 aa, Homo sapiens
  Native (MAGC1_HUMAN)
PVSPSFSSTLVSLFQSSPERT

SEQ ID NO: 251659 - protein, 22 aa, Homo sapiens
  Native (MAGC1_HUMAN)
PVSPSFSSTLVSLFQSSPERTQ

SEQ ID NO: 251660 - protein, 23 aa, Homo sapiens
  Native (MAGC1_HUMAN)
PVSPSFSSTLVSLFQSSPERTQS

SEQ ID NO: 251661 - protein, 24 aa, Homo sapiens
  Native (MAGC1_HUMAN)
PVSPSFSSTLVSLFQSSPERTQST

SEQ ID NO: 251662 - protein, 25 aa, Homo sapiens
  Native (MAGC1_HUMAN)
PVSPSFSSTLVSLFQSSPERTQSTF

SEQ ID NO: 251663 - protein, 13 aa, Homo sapiens
  Native (MAGC1_HUMAN)
PVSPSSSSTLLSL

SEQ ID NO: 251664 - protein, 14 aa, Homo sapiens
  Native (MAGC1_HUMAN)
PVSPSSSSTLLSLF

SEQ ID NO: 251665 - protein, 15 aa, Homo sapiens
  Native (MAGC1_HUMAN)
PVSPSSSSTLLSLFQ

SEQ ID NO: 251666 - protein, 16 aa, Homo sapiens
  Native (MAGC1_HUMAN)
PVSPSSSSTLLSLFQS

SEQ ID NO: 251667 - protein, 17 aa, Homo sapiens
  Native (MAGC1_HUMAN)
PVSPSSSSTLLSLFQSF

SEQ ID NO: 251668 - protein, 18 aa, Homo sapiens
  Native (MAGC1_HUMAN)
PVSPSSSSTLLSLFQSFS

SEQ ID NO: 251669 - protein, 19 aa, Homo sapiens
  Native (MAGC1_HUMAN)
PVSPSSSSTLLSLFQSFSE

SEQ ID NO: 251670 - protein, 20 aa, Homo sapiens
  Native (MAGC1_HUMAN)
PVSPSSSSTLLSLFQSFSER

SEQ ID NO: 251671 - protein, 21 aa, Homo sapiens
  Native (MAGC1_HUMAN)
PVSPSSSSTLLSLFQSFSERT

SEQ ID NO: 251672 - protein, 22 aa, Homo sapiens
  Native (MAGC1_HUMAN)
PVSPSSSSTLLSLFQSFSERTQ

SEQ ID NO: 251673 - protein, 23 aa, Homo sapiens
  Native (MAGC1_HUMAN)
PVSPSSSSTLLSLFQSFSERTQS

SEQ ID NO: 251674 - protein, 24 aa, Homo sapiens
  Native (MAGC1_HUMAN)
PVSPSSSSTLLSLFQSFSERTQST

SEQ ID NO: 251675 - protein, 25 aa, Homo sapiens
  Native (MAGC1_HUMAN)
PVSPSSSSTLLSLFQSFSERTQSTF

SEQ ID NO: 251676 - protein, 13 aa, Homo sapiens
  Native (MAGC1_HUMAN)
PVSRSFSSTLLSI

SEQ ID NO: 251677 - protein, 14 aa, Homo sapiens
  Native (MAGC1_HUMAN)
PVSRSFSSTLLSIF

SEQ ID NO: 251678 - protein, 15 aa, Homo sapiens
  Native (MAGC1_HUMAN)
PVSRSFSSTLLSIFQ

SEQ ID NO: 251679 - protein, 16 aa, Homo sapiens
  Native (MAGC1_HUMAN)
PVSRSFSSTLLSIFQS

SEQ ID NO: 251680 - protein, 17 aa, Homo sapiens
  Native (MAGC1_HUMAN)
PVSRSFSSTLLSIFQSS

SEQ ID NO: 251681 - protein, 18 aa, Homo sapiens
  Native (MAGC1_HUMAN)
PVSRSFSSTLLSIFQSSP

SEQ ID NO: 251682 - protein, 19 aa, Homo sapiens
  Native (MAGC1_HUMAN)
PVSRSFSSTLLSIFQSSPE

SEQ ID NO: 251683 - protein, 20 aa, Homo sapiens
  Native (MAGC1_HUMAN)
PVSRSFSSTLLSIFQSSPER

SEQ ID NO: 251684 - protein, 21 aa, Homo sapiens
  Native (MAGC1_HUMAN)
PVSRSFSSTLLSIFQSSPERT

SEQ ID NO: 251685 - protein, 22 aa, Homo sapiens
  Native (MAGC1_HUMAN)
PVSRSFSSTLLSIFQSSPERTQ

SEQ ID NO: 251686 - protein, 23 aa, Homo sapiens
  Native (MAGC1_HUMAN)
PVSRSFSSTLLSIFQSSPERTQS

SEQ ID NO: 251687 - protein, 24 aa, Homo sapiens
  Native (MAGC1_HUMAN)
PVSRSFSSTLLSIFQSSPERTQST

SEQ ID NO: 251688 - protein, 25 aa, Homo sapiens
  Native (MAGC1_HUMAN)
PVSRSFSSTLLSIFQSSPERTQSTF

SEQ ID NO: 251689 - protein, 13 aa, Homo sapiens
  Native (MAGC1_HUMAN)
PVSSFFSYTLASL

SEQ ID NO: 251690 - protein, 14 aa, Homo sapiens
  Native (MAGC1_HUMAN)
PVSSFFSYTLASLL

SEQ ID NO: 251691 - protein, 15 aa, Homo sapiens
  Native (MAGC1_HUMAN)
PVSSFFSYTLASLLQ

SEQ ID NO: 251692 - protein, 16 aa, Homo sapiens
  Native (MAGC1_HUMAN)
PVSSFFSYTLASLLQS

SEQ ID NO: 251693 - protein, 17 aa, Homo sapiens
  Native (MAGC1_HUMAN)
PVSSFFSYTLASLLQSS

SEQ ID NO: 251694 - protein, 18 aa, Homo sapiens
  Native (MAGC1_HUMAN)
PVSSFFSYTLASLLQSSH

SEQ ID NO: 251695 - protein, 19 aa, Homo sapiens
  Native (MAGC1_HUMAN)
PVSSFFSYTLASLLQSSHE

SEQ ID NO: 251696 - protein, 20 aa, Homo sapiens
  Native (MAGC1_HUMAN)
PVSSFFSYTLASLLQSSHES

SEQ ID NO: 251697 - protein, 21 aa, Homo sapiens
  Native (MAGC1_HUMAN)
PVSSFFSYTLASLLQSSHESP

SEQ ID NO: 251698 - protein, 22 aa, Homo sapiens
  Native (MAGC1_HUMAN)
PVSSFFSYTLASLLQSSHESPQ

SEQ ID NO: 251699 - protein, 23 aa, Homo sapiens
  Native (MAGC1_HUMAN)
PVSSFFSYTLASLLQSSHESPQS

SEQ ID NO: 251700 - protein, 24 aa, Homo sapiens
  Native (MAGC1_HUMAN)
PVSSFFSYTLASLLQSSHESPQSP

SEQ ID NO: 251701 - protein, 25 aa, Homo sapiens
  Native (MAGC1_HUMAN)
PVSSFFSYTLASLLQSSHESPQSPP

SEQ ID NO: 251702 - protein, 14 aa, Homo sapiens
  Native (MAGC1_HUMAN)
PVSSFPSSTSSSLS

SEQ ID NO: 251703 - protein, 15 aa, Homo sapiens
  Native (MAGC1_HUMAN)
PVSSFPSSTSSSLSK

SEQ ID NO: 251704 - protein, 16 aa, Homo sapiens
  Native (MAGC1_HUMAN)
PVSSFPSSTSSSLSKS

SEQ ID NO: 251705 - protein, 17 aa, Homo sapiens
  Native (MAGC1_HUMAN)
PVSSFPSSTSSSLSKSS

SEQ ID NO: 251706 - protein, 18 aa, Homo sapiens
  Native (MAGC1_HUMAN)
PVSSFPSSTSSSLSKSSP

SEQ ID NO: 251707 - protein, 19 aa, Homo sapiens
  Native (MAGC1_HUMAN)
PVSSFPSSTSSSLSKSSPE

SEQ ID NO: 251708 - protein, 20 aa, Homo sapiens
  Native (MAGC1_HUMAN)
PVSSFPSSTSSSLSKSSPES

SEQ ID NO: 251709 - protein, 21 aa, Homo sapiens
  Native (MAGC1_HUMAN)
PVSSFPSSTSSSLSKSSPESP

SEQ ID NO: 251710 - protein, 22 aa, Homo sapiens
  Native (MAGC1_HUMAN)
PVSSFPSSTSSSLSKSSPESPL

SEQ ID NO: 251711 - protein, 23 aa, Homo sapiens
  Native (MAGC1_HUMAN)
PVSSFPSSTSSSLSKSSPESPLQ

SEQ ID NO: 251712 - protein, 24 aa, Homo sapiens
  Native (MAGC1_HUMAN)
PVSSFPSSTSSSLSKSSPESPLQS

SEQ ID NO: 251713 - protein, 25 aa, Homo sapiens
  Native (MAGC1_HUMAN)
PVSSFPSSTSSSLSKSSPESPLQSP

SEQ ID NO: 251714 - protein, 15 aa, Homo sapiens
  Native (MAGC1_HUMAN)
PVSSFPSSTSSSLSQ

SEQ ID NO: 251715 - protein, 16 aa, Homo sapiens
  Native (MAGC1_HUMAN)
PVSSFPSSTSSSLSQS

SEQ ID NO: 251716 - protein, 17 aa, Homo sapiens
  Native (MAGC1_HUMAN)
PVSSFPSSTSSSLSQSS

SEQ ID NO: 251717 - protein, 18 aa, Homo sapiens
  Native (MAGC1_HUMAN)
PVSSFPSSTSSSLSQSSP

SEQ ID NO: 251718 - protein, 19 aa, Homo sapiens
  Native (MAGC1_HUMAN)
PVSSFPSSTSSSLSQSSPV

SEQ ID NO: 251719 - protein, 20 aa, Homo sapiens
  Native (MAGC1_HUMAN)
PVSSFPSSTSSSLSQSSPVS

SEQ ID NO: 251720 - protein, 21 aa, Homo sapiens
  Native (MAGC1_HUMAN)
PVSSFPSSTSSSLSQSSPVSS

SEQ ID NO: 251721 - protein, 22 aa, Homo sapiens
  Native (MAGC1_HUMAN)
PVSSFPSSTSSSLSQSSPVSSF

SEQ ID NO: 251722 - protein, 23 aa, Homo sapiens
  Native (MAGC1_HUMAN)
PVSSFPSSTSSSLSQSSPVSSFP

SEQ ID NO: 251723 - protein, 24 aa, Homo sapiens
  Native (MAGC1_HUMAN)
PVSSFPSSTSSSLSQSSPVSSFPS

SEQ ID NO: 251724 - protein, 25 aa, Homo sapiens
  Native (MAGC1_HUMAN)
PVSSFPSSTSSSLSQSSPVSSFPSS

SEQ ID NO: 251725 - protein, 13 aa, Homo sapiens
  Native (MAGC1_HUMAN)
PVSSSFSYTLLSL

SEQ ID NO: 251726 - protein, 14 aa, Homo sapiens
  Native (MAGC1_HUMAN)
PVSSSFSYTLLSLF

SEQ ID NO: 251727 - protein, 15 aa, Homo sapiens
  Native (MAGC1_HUMAN)
PVSSSFSYTLLSLFQ

SEQ ID NO: 251728 - protein, 16 aa, Homo sapiens
  Native (MAGC1_HUMAN)
PVSSSFSYTLLSLFQS

SEQ ID NO: 251729 - protein, 17 aa, Homo sapiens
  Native (MAGC1_HUMAN)
PVSSSFSYTLLSLFQSS

SEQ ID NO: 251730 - protein, 18 aa, Homo sapiens
  Native (MAGC1_HUMAN)
PVSSSFSYTLLSLFQSSP

SEQ ID NO: 251731 - protein, 19 aa, Homo sapiens
  Native (MAGC1_HUMAN)
PVSSSFSYTLLSLFQSSPE

SEQ ID NO: 251732 - protein, 20 aa, Homo sapiens
  Native (MAGC1_HUMAN)
PVSSSFSYTLLSLFQSSPER

SEQ ID NO: 251733 - protein, 21 aa, Homo sapiens
  Native (MAGC1_HUMAN)
PVSSSFSYTLLSLFQSSPERT

SEQ ID NO: 251734 - protein, 22 aa, Homo sapiens
  Native (MAGC1_HUMAN)
PVSSSFSYTLLSLFQSSPERTH

SEQ ID NO: 251735 - protein, 23 aa, Homo sapiens
  Native (MAGC1_HUMAN)
PVSSSFSYTLLSLFQSSPERTHS

SEQ ID NO: 251736 - protein, 24 aa, Homo sapiens
  Native (MAGC1_HUMAN)
PVSSSFSYTLLSLFQSSPERTHST

SEQ ID NO: 251737 - protein, 25 aa, Homo sapiens
  Native (MAGC1_HUMAN)
PVSSSFSYTLLSLFQSSPERTHSTF

SEQ ID NO: 251738 - protein, 13 aa, Homo sapiens
  Native (MAGC1_HUMAN)
PVSSSSSSSTLLS

SEQ ID NO: 251739 - protein, 14 aa, Homo sapiens
  Native (MAGC1_HUMAN)
PVSSSSSSSTLLSL

SEQ ID NO: 251740 - protein, 15 aa, Homo sapiens
  Native (MAGC1_HUMAN)
PVSSSSSSSTLLSLF

SEQ ID NO: 251741 - protein, 16 aa, Homo sapiens
  Native (MAGC1_HUMAN)
PVSSSSSSSTLLSLFQ

SEQ ID NO: 251742 - protein, 17 aa, Homo sapiens
  Native (MAGC1_HUMAN)
PVSSSSSSSTLLSLFQS

SEQ ID NO: 251743 - protein, 18 aa, Homo sapiens
  Native (MAGC1_HUMAN)
PVSSSSSSSTLLSLFQSS

SEQ ID NO: 251744 - protein, 19 aa, Homo sapiens
  Native (MAGC1_HUMAN)
PVSSSSSSSTLLSLFQSSP

SEQ ID NO: 251745 - protein, 20 aa, Homo sapiens
  Native (MAGC1_HUMAN)
PVSSSSSSSTLLSLFQSSPE

SEQ ID NO: 251746 - protein, 21 aa, Homo sapiens
  Native (MAGC1_HUMAN)
PVSSSSSSSTLLSLFQSSPEC

SEQ ID NO: 251747 - protein, 22 aa, Homo sapiens
  Native (MAGC1_HUMAN)
PVSSSSSSSTLLSLFQSSPECT

SEQ ID NO: 251748 - protein, 23 aa, Homo sapiens
  Native (MAGC1_HUMAN)
PVSSSSSSSTLLSLFQSSPECTQ

SEQ ID NO: 251749 - protein, 24 aa, Homo sapiens
  Native (MAGC1_HUMAN)
PVSSSSSSSTLLSLFQSSPECTQS

SEQ ID NO: 251750 - protein, 25 aa, Homo sapiens
  Native (MAGC1_HUMAN)
PVSSSSSSSTLLSLFQSSPECTQST

SEQ ID NO: 251751 - protein, 13 aa, Homo sapiens
  Native (MAGC1_HUMAN)
PVSSSSSSTLLSL

SEQ ID NO: 251752 - protein, 14 aa, Homo sapiens
  Native (MAGC1_HUMAN)
PVSSSSSSTLLSLF

SEQ ID NO: 251753 - protein, 15 aa, Homo sapiens
  Native (MAGC1_HUMAN)
PVSSSSSSTLLSLFQ

SEQ ID NO: 251754 - protein, 16 aa, Homo sapiens
  Native (MAGC1_HUMAN)
PVSSSSSSTLLSLFQS

SEQ ID NO: 251755 - protein, 17 aa, Homo sapiens
  Native (MAGC1_HUMAN)
PVSSSSSSTLLSLFQSS

SEQ ID NO: 251756 - protein, 18 aa, Homo sapiens
  Native (MAGC1_HUMAN)
PVSSSSSSTLLSLFQSSP

SEQ ID NO: 251757 - protein, 19 aa, Homo sapiens
  Native (MAGC1_HUMAN)
PVSSSSSSTLLSLFQSSPE

SEQ ID NO: 251758 - protein, 20 aa, Homo sapiens
  Native (MAGC1_HUMAN)
PVSSSSSSTLLSLFQSSPER

SEQ ID NO: 251759 - protein, 21 aa, Homo sapiens
  Native (MAGC1_HUMAN)
PVSSSSSSTLLSLFQSSPERT

SEQ ID NO: 251760 - protein, 22 aa, Homo sapiens
  Native (MAGC1_HUMAN)
PVSSSSSSTLLSLFQSSPERTH

SEQ ID NO: 251761 - protein, 23 aa, Homo sapiens
  Native (MAGC1_HUMAN)
PVSSSSSSTLLSLFQSSPERTHS

SEQ ID NO: 251762 - protein, 24 aa, Homo sapiens
  Native (MAGC1_HUMAN)
PVSSSSSSTLLSLFQSSPERTHST

SEQ ID NO: 251763 - protein, 25 aa, Homo sapiens
  Native (MAGC1_HUMAN)
PVSSSSSSTLLSLFQSSPERTHSTF

SEQ ID NO: 251764 - protein, 20 aa, Homo sapiens
  Native (MAGC1_HUMAN)
QAIIDTTDDSTATESASSSV

SEQ ID NO: 251765 - protein, 21 aa, Homo sapiens
  Native (MAGC1_HUMAN)
QAIIDTTDDSTATESASSSVM

SEQ ID NO: 251766 - protein, 22 aa, Homo sapiens
  Native (MAGC1_HUMAN)
QAIIDTTDDSTATESASSSVMS

SEQ ID NO: 251767 - protein, 23 aa, Homo sapiens
  Native (MAGC1_HUMAN)
QAIIDTTDDSTATESASSSVMSP

SEQ ID NO: 251768 - protein, 24 aa, Homo sapiens
  Native (MAGC1_HUMAN)
QAIIDTTDDSTATESASSSVMSPS

SEQ ID NO: 251769 - protein, 25 aa, Homo sapiens
  Native (MAGC1_HUMAN)
QAIIDTTDDSTATESASSSVMSPSF

SEQ ID NO: 251770 - protein, 15 aa, Homo sapiens
  Native (MAGC1_HUMAN)
QEHYLEYREVPNSSP

SEQ ID NO: 251771 - protein, 17 aa, Homo sapiens
  Native (MAGC1_HUMAN)
QEHYLEYREVPNSSPPR

SEQ ID NO: 251772 - protein, 19 aa, Homo sapiens
  Native (MAGC1_HUMAN)
QEHYLEYREVPNSSPPRYE

SEQ ID NO: 251773 - protein, 20 aa, Homo sapiens
  Native (MAGC1_HUMAN)
QEHYLEYREVPNSSPPRYEF

SEQ ID NO: 251774 - protein, 24 aa, Homo sapiens
  Native (MAGC1_HUMAN)
QEHYLEYREVPNSSPPRYEFLWGP

SEQ ID NO: 251775 - protein, 25 aa, Homo sapiens
  Native (MAGC1_HUMAN)
QEHYLEYREVPNSSPPRYEFLWGPR

SEQ ID NO: 251776 - protein, 17 aa, Homo sapiens
  Native (MAGC1_HUMAN)
QFPPQGEDFQSSLQSPV

SEQ ID NO: 251777 - protein, 19 aa, Homo sapiens
  Native (MAGC1_HUMAN)
QFPPQGEDFQSSLQSPVSI

SEQ ID NO: 251778 - protein, 20 aa, Homo sapiens
  Native (MAGC1_HUMAN)
QFPPQGEDFQSSLQSPVSIC

SEQ ID NO: 251779 - protein, 21 aa, Homo sapiens
  Native (MAGC1_HUMAN)
QFPPQGEDFQSSLQSPVSICS

SEQ ID NO: 251780 - protein, 22 aa, Homo sapiens
  Native (MAGC1_HUMAN)
QFPPQGEDFQSSLQSPVSICSS

SEQ ID NO: 251781 - protein, 23 aa, Homo sapiens
  Native (MAGC1_HUMAN)
QFPPQGEDFQSSLQSPVSICSSS

SEQ ID NO: 251782 - protein, 24 aa, Homo sapiens
  Native (MAGC1_HUMAN)
QFPPQGEDFQSSLQSPVSICSSST

SEQ ID NO: 251783 - protein, 25 aa, Homo sapiens
  Native (MAGC1_HUMAN)
QFPPQGEDFQSSLQSPVSICSSSTS

SEQ ID NO: 251784 - protein, 14 aa, Homo sapiens
  Native (MAGC1_HUMAN)
QGEDFQSSLQSPVS

SEQ ID NO: 251785 - protein, 16 aa, Homo sapiens
  Native (MAGC1_HUMAN)
QGEDFQSSLQSPVSIC

SEQ ID NO: 251786 - protein, 17 aa, Homo sapiens
  Native (MAGC1_HUMAN)
QGEDFQSSLQSPVSICS

SEQ ID NO: 251787 - protein, 19 aa, Homo sapiens
  Native (MAGC1_HUMAN)
QGEDFQSSLQSPVSICSSS

SEQ ID NO: 251788 - protein, 20 aa, Homo sapiens
  Native (MAGC1_HUMAN)
QGEDFQSSLQSPVSICSSST

SEQ ID NO: 251789 - protein, 21 aa, Homo sapiens
  Native (MAGC1_HUMAN)
QGEDFQSSLQSPVSICSSSTS

SEQ ID NO: 251790 - protein, 22 aa, Homo sapiens
  Native (MAGC1_HUMAN)
QGEDFQSSLQSPVSICSSSTSL

SEQ ID NO: 251791 - protein, 23 aa, Homo sapiens
  Native (MAGC1_HUMAN)
QGEDFQSSLQSPVSICSSSTSLS

SEQ ID NO: 251792 - protein, 24 aa, Homo sapiens
  Native (MAGC1_HUMAN)
QGEDFQSSLQSPVSICSSSTSLSL

SEQ ID NO: 251793 - protein, 25 aa, Homo sapiens
  Native (MAGC1_HUMAN)
QGEDFQSSLQSPVSICSSSTSLSLP

SEQ ID NO: 251794 - protein, 17 aa, Homo sapiens
  Native (MAGC1_HUMAN)
QGEDSMSPLYFPQSPLQ

SEQ ID NO: 251795 - protein, 19 aa, Homo sapiens
  Native (MAGC1_HUMAN)
QGEDSMSPLYFPQSPLQGE

SEQ ID NO: 251796 - protein, 20 aa, Homo sapiens
  Native (MAGC1_HUMAN)
QGEDSMSPLYFPQSPLQGEE

SEQ ID NO: 251797 - protein, 21 aa, Homo sapiens
  Native (MAGC1_HUMAN)
QGEDSMSPLYFPQSPLQGEEF

SEQ ID NO: 251798 - protein, 22 aa, Homo sapiens
  Native (MAGC1_HUMAN)
QGEDSMSPLYFPQSPLQGEEFQ

SEQ ID NO: 251799 - protein, 23 aa, Homo sapiens
  Native (MAGC1_HUMAN)
QGEDSMSPLYFPQSPLQGEEFQS

SEQ ID NO: 251800 - protein, 24 aa, Homo sapiens
  Native (MAGC1_HUMAN)
QGEDSMSPLYFPQSPLQGEEFQSS

SEQ ID NO: 251801 - protein, 25 aa, Homo sapiens
  Native (MAGC1_HUMAN)
QGEDSMSPLYFPQSPLQGEEFQSSL

SEQ ID NO: 251802 - protein, 14 aa, Homo sapiens
  Native (MAGC1_HUMAN)
QGEEFQSSLQSPVS

SEQ ID NO: 251803 - protein, 16 aa, Homo sapiens
  Native (MAGC1_HUMAN)
QGEEFQSSLQSPVSIC

SEQ ID NO: 251804 - protein, 17 aa, Homo sapiens
  Native (MAGC1_HUMAN)
QGEEFQSSLQSPVSICS

SEQ ID NO: 251805 - protein, 19 aa, Homo sapiens
  Native (MAGC1_HUMAN)
QGEEFQSSLQSPVSICSSS

SEQ ID NO: 251806 - protein, 20 aa, Homo sapiens
  Native (MAGC1_HUMAN)
QGEEFQSSLQSPVSICSSST

SEQ ID NO: 251807 - protein, 21 aa, Homo sapiens
  Native (MAGC1_HUMAN)
QGEEFQSSLQSPVSICSSSTP

SEQ ID NO: 251808 - protein, 22 aa, Homo sapiens
  Native (MAGC1_HUMAN)
QGEEFQSSLQSPVSICSSSTPS

SEQ ID NO: 251809 - protein, 23 aa, Homo sapiens
  Native (MAGC1_HUMAN)
QGEEFQSSLQSPVSICSSSTPSS

SEQ ID NO: 251810 - protein, 24 aa, Homo sapiens
  Native (MAGC1_HUMAN)
QGEEFQSSLQSPVSICSSSTPSSL

SEQ ID NO: 251811 - protein, 25 aa, Homo sapiens
  Native (MAGC1_HUMAN)
QGEEFQSSLQSPVSICSSSTPSSLP

SEQ ID NO: 251812 - protein, 13 aa, Homo sapiens
  Native (MAGC1_HUMAN)
QGMSQNRLLILIL

SEQ ID NO: 251813 - protein, 14 aa, Homo sapiens
  Native (MAGC1_HUMAN)
QGMSQNRLLILILS

SEQ ID NO: 251814 - protein, 15 aa, Homo sapiens
  Native (MAGC1_HUMAN)
QGMSQNRLLILILSI

SEQ ID NO: 251815 - protein, 16 aa, Homo sapiens
  Native (MAGC1_HUMAN)
QGMSQNRLLILILSII

SEQ ID NO: 251816 - protein, 17 aa, Homo sapiens
  Native (MAGC1_HUMAN)
QGMSQNRLLILILSIIF

SEQ ID NO: 251817 - protein, 18 aa, Homo sapiens
  Native (MAGC1_HUMAN)
QGMSQNRLLILILSIIFI

SEQ ID NO: 251818 - protein, 19 aa, Homo sapiens
  Native (MAGC1_HUMAN)
QGMSQNRLLILILSIIFIK

SEQ ID NO: 251819 - protein, 20 aa, Homo sapiens
  Native (MAGC1_HUMAN)
QGMSQNRLLILILSIIFIKG

SEQ ID NO: 251820 - protein, 21 aa, Homo sapiens
  Native (MAGC1_HUMAN)
QGMSQNRLLILILSIIFIKGT

SEQ ID NO: 251821 - protein, 22 aa, Homo sapiens
  Native (MAGC1_HUMAN)
QGMSQNRLLILILSIIFIKGTY

SEQ ID NO: 251822 - protein, 23 aa, Homo sapiens
  Native (MAGC1_HUMAN)
QGMSQNRLLILILSIIFIKGTYA

SEQ ID NO: 251823 - protein, 24 aa, Homo sapiens
  Native (MAGC1_HUMAN)
QGMSQNRLLILILSIIFIKGTYAS

SEQ ID NO: 251824 - protein, 25 aa, Homo sapiens
  Native (MAGC1_HUMAN)
QGMSQNRLLILILSIIFIKGTYASE

SEQ ID NO: 251825 - protein, 14 aa, Homo sapiens
  Native (MAGC1_HUMAN)
QIPGSPSFSSTLLS

SEQ ID NO: 251826 - protein, 15 aa, Homo sapiens
  Native (MAGC1_HUMAN)
QIPGSPSFSSTLLSL

SEQ ID NO: 251827 - protein, 16 aa, Homo sapiens
  Native (MAGC1_HUMAN)
QIPGSPSFSSTLLSLF

SEQ ID NO: 251828 - protein, 17 aa, Homo sapiens
  Native (MAGC1_HUMAN)
QIPGSPSFSSTLLSLFQ

SEQ ID NO: 251829 - protein, 18 aa, Homo sapiens
  Native (MAGC1_HUMAN)
QIPGSPSFSSTLLSLFQS

SEQ ID NO: 251830 - protein, 19 aa, Homo sapiens
  Native (MAGC1_HUMAN)
QIPGSPSFSSTLLSLFQSS

SEQ ID NO: 251831 - protein, 20 aa, Homo sapiens
  Native (MAGC1_HUMAN)
QIPGSPSFSSTLLSLFQSSP

SEQ ID NO: 251832 - protein, 21 aa, Homo sapiens
  Native (MAGC1_HUMAN)
QIPGSPSFSSTLLSLFQSSPE

SEQ ID NO: 251833 - protein, 22 aa, Homo sapiens
  Native (MAGC1_HUMAN)
QIPGSPSFSSTLLSLFQSSPER

SEQ ID NO: 251834 - protein, 23 aa, Homo sapiens
  Native (MAGC1_HUMAN)
QIPGSPSFSSTLLSLFQSSPERT

SEQ ID NO: 251835 - protein, 24 aa, Homo sapiens
  Native (MAGC1_HUMAN)
QIPGSPSFSSTLLSLFQSSPERTH

SEQ ID NO: 251836 - protein, 25 aa, Homo sapiens
  Native (MAGC1_HUMAN)
QIPGSPSFSSTLLSLFQSSPERTHS

SEQ ID NO: 251837 - protein, 14 aa, Homo sapiens
  Native (MAGC1_HUMAN)
QIPMTSSFSSTLLS

SEQ ID NO: 251838 - protein, 15 aa, Homo sapiens
  Native (MAGC1_HUMAN)
QIPMTSSFSSTLLSI

SEQ ID NO: 251839 - protein, 16 aa, Homo sapiens
  Native (MAGC1_HUMAN)
QIPMTSSFSSTLLSIF

SEQ ID NO: 251840 - protein, 17 aa, Homo sapiens
  Native (MAGC1_HUMAN)
QIPMTSSFSSTLLSIFQ

SEQ ID NO: 251841 - protein, 18 aa, Homo sapiens
  Native (MAGC1_HUMAN)
QIPMTSSFSSTLLSIFQS

SEQ ID NO: 251842 - protein, 19 aa, Homo sapiens
  Native (MAGC1_HUMAN)
QIPMTSSFSSTLLSIFQSS

SEQ ID NO: 251843 - protein, 20 aa, Homo sapiens
  Native (MAGC1_HUMAN)
QIPMTSSFSSTLLSIFQSSP

SEQ ID NO: 251844 - protein, 21 aa, Homo sapiens
  Native (MAGC1_HUMAN)
QIPMTSSFSSTLLSIFQSSPE

SEQ ID NO: 251845 - protein, 22 aa, Homo sapiens
  Native (MAGC1_HUMAN)
QIPMTSSFSSTLLSIFQSSPES

SEQ ID NO: 251846 - protein, 23 aa, Homo sapiens
  Native (MAGC1_HUMAN)
QIPMTSSFSSTLLSIFQSSPESA

SEQ ID NO: 251847 - protein, 24 aa, Homo sapiens
  Native (MAGC1_HUMAN)
QIPMTSSFSSTLLSIFQSSPESAQ

SEQ ID NO: 251848 - protein, 25 aa, Homo sapiens
  Native (MAGC1_HUMAN)
QIPMTSSFSSTLLSIFQSSPESAQS

SEQ ID NO: 251849 - protein, 16 aa, Homo sapiens
  Native (MAGC1_HUMAN)
QIPMTSSFSSTLLSIL

SEQ ID NO: 251850 - protein, 17 aa, Homo sapiens
  Native (MAGC1_HUMAN)
QIPMTSSFSSTLLSILQ

SEQ ID NO: 251851 - protein, 18 aa, Homo sapiens
  Native (MAGC1_HUMAN)
QIPMTSSFSSTLLSILQS

SEQ ID NO: 251852 - protein, 19 aa, Homo sapiens
  Native (MAGC1_HUMAN)
QIPMTSSFSSTLLSILQSS

SEQ ID NO: 251853 - protein, 20 aa, Homo sapiens
  Native (MAGC1_HUMAN)
QIPMTSSFSSTLLSILQSSP

SEQ ID NO: 251854 - protein, 21 aa, Homo sapiens
  Native (MAGC1_HUMAN)
QIPMTSSFSSTLLSILQSSPE

SEQ ID NO: 251855 - protein, 22 aa, Homo sapiens
  Native (MAGC1_HUMAN)
QIPMTSSFSSTLLSILQSSPES

SEQ ID NO: 251856 - protein, 23 aa, Homo sapiens
  Native (MAGC1_HUMAN)
QIPMTSSFSSTLLSILQSSPESA

SEQ ID NO: 251857 - protein, 24 aa, Homo sapiens
  Native (MAGC1_HUMAN)
QIPMTSSFSSTLLSILQSSPESAQ

SEQ ID NO: 251858 - protein, 25 aa, Homo sapiens
  Native (MAGC1_HUMAN)
QIPMTSSFSSTLLSILQSSPESAQS

SEQ ID NO: 251859 - protein, 22 aa, Homo sapiens
  Native (MAGC1_HUMAN)
QIPQSPLEGEDSLSSLHFPQSP

SEQ ID NO: 251860 - protein, 23 aa, Homo sapiens
  Native (MAGC1_HUMAN)
QIPQSPLEGEDSLSSLHFPQSPP

SEQ ID NO: 251861 - protein, 24 aa, Homo sapiens
  Native (MAGC1_HUMAN)
QIPQSPLEGEDSLSSLHFPQSPPE

SEQ ID NO: 251862 - protein, 25 aa, Homo sapiens
  Native (MAGC1_HUMAN)
QIPQSPLEGEDSLSSLHFPQSPPEW

SEQ ID NO: 251863 - protein, 22 aa, Homo sapiens
  Native (MAGC1_HUMAN)
QIPQSPPEGENTHSPLQIVPSL

SEQ ID NO: 251864 - protein, 23 aa, Homo sapiens
  Native (MAGC1_HUMAN)
QIPQSPPEGENTHSPLQIVPSLP

SEQ ID NO: 251865 - protein, 24 aa, Homo sapiens
  Native (MAGC1_HUMAN)
QIPQSPPEGENTHSPLQIVPSLPE

SEQ ID NO: 251866 - protein, 25 aa, Homo sapiens
  Native (MAGC1_HUMAN)
QIPQSPPEGENTHSPLQIVPSLPEW

SEQ ID NO: 251867 - protein, 22 aa, Homo sapiens
  Native (MAGC1_HUMAN)
QIPQSSPESDDTLYPLQSPQSR

SEQ ID NO: 251868 - protein, 23 aa, Homo sapiens
  Native (MAGC1_HUMAN)
QIPQSSPESDDTLYPLQSPQSRS

SEQ ID NO: 251869 - protein, 24 aa, Homo sapiens
  Native (MAGC1_HUMAN)
QIPQSSPESDDTLYPLQSPQSRSE

SEQ ID NO: 251870 - protein, 25 aa, Homo sapiens
  Native (MAGC1_HUMAN)
QIPQSSPESDDTLYPLQSPQSRSEG

SEQ ID NO: 251871 - protein, 13 aa, Homo sapiens
  Native (MAGC1_HUMAN)
QIPVSAASSSTLV

SEQ ID NO: 251872 - protein, 14 aa, Homo sapiens
  Native (MAGC1_HUMAN)
QIPVSAASSSTLVS

SEQ ID NO: 251873 - protein, 16 aa, Homo sapiens
  Native (MAGC1_HUMAN)
QIPVSAASSSTLVSIF

SEQ ID NO: 251874 - protein, 17 aa, Homo sapiens
  Native (MAGC1_HUMAN)
QIPVSAASSSTLVSIFQ

SEQ ID NO: 251875 - protein, 18 aa, Homo sapiens
  Native (MAGC1_HUMAN)
QIPVSAASSSTLVSIFQS

SEQ ID NO: 251876 - protein, 19 aa, Homo sapiens
  Native (MAGC1_HUMAN)
QIPVSAASSSTLVSIFQSS

SEQ ID NO: 251877 - protein, 20 aa, Homo sapiens
  Native (MAGC1_HUMAN)
QIPVSAASSSTLVSIFQSSP

SEQ ID NO: 251878 - protein, 21 aa, Homo sapiens
  Native (MAGC1_HUMAN)
QIPVSAASSSTLVSIFQSSPE

SEQ ID NO: 251879 - protein, 22 aa, Homo sapiens
  Native (MAGC1_HUMAN)
QIPVSAASSSTLVSIFQSSPES

SEQ ID NO: 251880 - protein, 23 aa, Homo sapiens
  Native (MAGC1_HUMAN)
QIPVSAASSSTLVSIFQSSPEST

SEQ ID NO: 251881 - protein, 24 aa, Homo sapiens
  Native (MAGC1_HUMAN)
QIPVSAASSSTLVSIFQSSPESTQ

SEQ ID NO: 251882 - protein, 25 aa, Homo sapiens
  Native (MAGC1_HUMAN)
QIPVSAASSSTLVSIFQSSPESTQS

SEQ ID NO: 251883 - protein, 14 aa, Homo sapiens
  Native (MAGC1_HUMAN)
QIPVSPSFSSTLVS

SEQ ID NO: 251884 - protein, 15 aa, Homo sapiens
  Native (MAGC1_HUMAN)
QIPVSPSFSSTLVSL

SEQ ID NO: 251885 - protein, 16 aa, Homo sapiens
  Native (MAGC1_HUMAN)
QIPVSPSFSSTLVSLF

SEQ ID NO: 251886 - protein, 17 aa, Homo sapiens
  Native (MAGC1_HUMAN)
QIPVSPSFSSTLVSLFQ

SEQ ID NO: 251887 - protein, 18 aa, Homo sapiens
  Native (MAGC1_HUMAN)
QIPVSPSFSSTLVSLFQS

SEQ ID NO: 251888 - protein, 19 aa, Homo sapiens
  Native (MAGC1_HUMAN)
QIPVSPSFSSTLVSLFQSS

SEQ ID NO: 251889 - protein, 21 aa, Homo sapiens
  Native (MAGC1_HUMAN)
QIPVSPSFSSTLVSLFQSSPE

SEQ ID NO: 251890 - protein, 22 aa, Homo sapiens
  Native (MAGC1_HUMAN)
QIPVSPSFSSTLVSLFQSSPER

SEQ ID NO: 251891 - protein, 23 aa, Homo sapiens
  Native (MAGC1_HUMAN)
QIPVSPSFSSTLVSLFQSSPERT

SEQ ID NO: 251892 - protein, 24 aa, Homo sapiens
  Native (MAGC1_HUMAN)
QIPVSPSFSSTLVSLFQSSPERTQ

SEQ ID NO: 251893 - protein, 25 aa, Homo sapiens
  Native (MAGC1_HUMAN)
QIPVSPSFSSTLVSLFQSSPERTQS

SEQ ID NO: 251894 - protein, 14 aa, Homo sapiens
  Native (MAGC1_HUMAN)
QIPVSPSSSSTLLS

SEQ ID NO: 251895 - protein, 15 aa, Homo sapiens
  Native (MAGC1_HUMAN)
QIPVSPSSSSTLLSL

SEQ ID NO: 251896 - protein, 16 aa, Homo sapiens
  Native (MAGC1_HUMAN)
QIPVSPSSSSTLLSLF

SEQ ID NO: 251897 - protein, 17 aa, Homo sapiens
  Native (MAGC1_HUMAN)
QIPVSPSSSSTLLSLFQ

SEQ ID NO: 251898 - protein, 18 aa, Homo sapiens
  Native (MAGC1_HUMAN)
QIPVSPSSSSTLLSLFQS

SEQ ID NO: 251899 - protein, 19 aa, Homo sapiens
  Native (MAGC1_HUMAN)
QIPVSPSSSSTLLSLFQSF

SEQ ID NO: 251900 - protein, 20 aa, Homo sapiens
  Native (MAGC1_HUMAN)
QIPVSPSSSSTLLSLFQSFS

SEQ ID NO: 251901 - protein, 21 aa, Homo sapiens
  Native (MAGC1_HUMAN)
QIPVSPSSSSTLLSLFQSFSE

SEQ ID NO: 251902 - protein, 22 aa, Homo sapiens
  Native (MAGC1_HUMAN)
QIPVSPSSSSTLLSLFQSFSER

SEQ ID NO: 251903 - protein, 23 aa, Homo sapiens
  Native (MAGC1_HUMAN)
QIPVSPSSSSTLLSLFQSFSERT

SEQ ID NO: 251904 - protein, 24 aa, Homo sapiens
  Native (MAGC1_HUMAN)
QIPVSPSSSSTLLSLFQSFSERTQ

SEQ ID NO: 251905 - protein, 25 aa, Homo sapiens
  Native (MAGC1_HUMAN)
QIPVSPSSSSTLLSLFQSFSERTQS

SEQ ID NO: 251906 - protein, 14 aa, Homo sapiens
  Native (MAGC1_HUMAN)
QIPVSRSFSSTLLS

SEQ ID NO: 251907 - protein, 16 aa, Homo sapiens
  Native (MAGC1_HUMAN)
QIPVSRSFSSTLLSIF

SEQ ID NO: 251908 - protein, 17 aa, Homo sapiens
  Native (MAGC1_HUMAN)
QIPVSRSFSSTLLSIFQ

SEQ ID NO: 251909 - protein, 18 aa, Homo sapiens
  Native (MAGC1_HUMAN)
QIPVSRSFSSTLLSIFQS

SEQ ID NO: 251910 - protein, 19 aa, Homo sapiens
  Native (MAGC1_HUMAN)
QIPVSRSFSSTLLSIFQSS

SEQ ID NO: 251911 - protein, 20 aa, Homo sapiens
  Native (MAGC1_HUMAN)
QIPVSRSFSSTLLSIFQSSP

SEQ ID NO: 251912 - protein, 21 aa, Homo sapiens
  Native (MAGC1_HUMAN)
QIPVSRSFSSTLLSIFQSSPE

SEQ ID NO: 251913 - protein, 22 aa, Homo sapiens
  Native (MAGC1_HUMAN)
QIPVSRSFSSTLLSIFQSSPER

SEQ ID NO: 251914 - protein, 23 aa, Homo sapiens
  Native (MAGC1_HUMAN)
QIPVSRSFSSTLLSIFQSSPERT

SEQ ID NO: 251915 - protein, 24 aa, Homo sapiens
  Native (MAGC1_HUMAN)
QIPVSRSFSSTLLSIFQSSPERTQ

SEQ ID NO: 251916 - protein, 25 aa, Homo sapiens
  Native (MAGC1_HUMAN)
QIPVSRSFSSTLLSIFQSSPERTQS

SEQ ID NO: 251917 - protein, 13 aa, Homo sapiens
  Native (MAGC1_HUMAN)
QIPVSSSFSYTLL

SEQ ID NO: 251918 - protein, 14 aa, Homo sapiens
  Native (MAGC1_HUMAN)
QIPVSSSFSYTLLS

SEQ ID NO: 251919 - protein, 16 aa, Homo sapiens
  Native (MAGC1_HUMAN)
QIPVSSSFSYTLLSLF

SEQ ID NO: 251920 - protein, 17 aa, Homo sapiens
  Native (MAGC1_HUMAN)
QIPVSSSFSYTLLSLFQ

SEQ ID NO: 251921 - protein, 18 aa, Homo sapiens
  Native (MAGC1_HUMAN)
QIPVSSSFSYTLLSLFQS

SEQ ID NO: 251922 - protein, 19 aa, Homo sapiens
  Native (MAGC1_HUMAN)
QIPVSSSFSYTLLSLFQSS

SEQ ID NO: 251923 - protein, 20 aa, Homo sapiens
  Native (MAGC1_HUMAN)
QIPVSSSFSYTLLSLFQSSP

SEQ ID NO: 251924 - protein, 21 aa, Homo sapiens
  Native (MAGC1_HUMAN)
QIPVSSSFSYTLLSLFQSSPE

SEQ ID NO: 251925 - protein, 22 aa, Homo sapiens
  Native (MAGC1_HUMAN)
QIPVSSSFSYTLLSLFQSSPER

SEQ ID NO: 251926 - protein, 23 aa, Homo sapiens
  Native (MAGC1_HUMAN)
QIPVSSSFSYTLLSLFQSSPERT

SEQ ID NO: 251927 - protein, 24 aa, Homo sapiens
  Native (MAGC1_HUMAN)
QIPVSSSFSYTLLSLFQSSPERTH

SEQ ID NO: 251928 - protein, 25 aa, Homo sapiens
  Native (MAGC1_HUMAN)
QIPVSSSFSYTLLSLFQSSPERTHS

SEQ ID NO: 251929 - protein, 13 aa, Homo sapiens
  Native (MAGC1_HUMAN)
QIPVSSSSSSSTL

SEQ ID NO: 251930 - protein, 14 aa, Homo sapiens
  Native (MAGC1_HUMAN)
QIPVSSSSSSSTLL

SEQ ID NO: 251931 - protein, 15 aa, Homo sapiens
  Native (MAGC1_HUMAN)
QIPVSSSSSSSTLLS

SEQ ID NO: 251932 - protein, 16 aa, Homo sapiens
  Native (MAGC1_HUMAN)
QIPVSSSSSSSTLLSL

SEQ ID NO: 251933 - protein, 17 aa, Homo sapiens
  Native (MAGC1_HUMAN)
QIPVSSSSSSSTLLSLF

SEQ ID NO: 251934 - protein, 18 aa, Homo sapiens
  Native (MAGC1_HUMAN)
QIPVSSSSSSSTLLSLFQ

SEQ ID NO: 251935 - protein, 19 aa, Homo sapiens
  Native (MAGC1_HUMAN)
QIPVSSSSSSSTLLSLFQS

SEQ ID NO: 251936 - protein, 20 aa, Homo sapiens
  Native (MAGC1_HUMAN)
QIPVSSSSSSSTLLSLFQSS

SEQ ID NO: 251937 - protein, 21 aa, Homo sapiens
  Native (MAGC1_HUMAN)
QIPVSSSSSSSTLLSLFQSSP

SEQ ID NO: 251938 - protein, 22 aa, Homo sapiens
  Native (MAGC1_HUMAN)
QIPVSSSSSSSTLLSLFQSSPE

SEQ ID NO: 251939 - protein, 23 aa, Homo sapiens
  Native (MAGC1_HUMAN)
QIPVSSSSSSSTLLSLFQSSPEC

SEQ ID NO: 251940 - protein, 24 aa, Homo sapiens
  Native (MAGC1_HUMAN)
QIPVSSSSSSSTLLSLFQSSPECT

SEQ ID NO: 251941 - protein, 25 aa, Homo sapiens
  Native (MAGC1_HUMAN)
QIPVSSSSSSSTLLSLFQSSPECTQ

SEQ ID NO: 251942 - protein, 13 aa, Homo sapiens
  Native (MAGC1_HUMAN)
QIPVSSSSSSTLL

SEQ ID NO: 251943 - protein, 14 aa, Homo sapiens
  Native (MAGC1_HUMAN)
QIPVSSSSSSTLLS

SEQ ID NO: 251944 - protein, 15 aa, Homo sapiens
  Native (MAGC1_HUMAN)
QIPVSSSSSSTLLSL

SEQ ID NO: 251945 - protein, 16 aa, Homo sapiens
  Native (MAGC1_HUMAN)
QIPVSSSSSSTLLSLF

SEQ ID NO: 251946 - protein, 17 aa, Homo sapiens
  Native (MAGC1_HUMAN)
QIPVSSSSSSTLLSLFQ

SEQ ID NO: 251947 - protein, 18 aa, Homo sapiens
  Native (MAGC1_HUMAN)
QIPVSSSSSSTLLSLFQS

SEQ ID NO: 251948 - protein, 19 aa, Homo sapiens
  Native (MAGC1_HUMAN)
QIPVSSSSSSTLLSLFQSS

SEQ ID NO: 251949 - protein, 20 aa, Homo sapiens
  Native (MAGC1_HUMAN)
QIPVSSSSSSTLLSLFQSSP

SEQ ID NO: 251950 - protein, 21 aa, Homo sapiens
  Native (MAGC1_HUMAN)
QIPVSSSSSSTLLSLFQSSPE

SEQ ID NO: 251951 - protein, 22 aa, Homo sapiens
  Native (MAGC1_HUMAN)
QIPVSSSSSSTLLSLFQSSPER

SEQ ID NO: 251952 - protein, 23 aa, Homo sapiens
  Native (MAGC1_HUMAN)
QIPVSSSSSSTLLSLFQSSPERT

SEQ ID NO: 251953 - protein, 24 aa, Homo sapiens
  Native (MAGC1_HUMAN)
QIPVSSSSSSTLLSLFQSSPERTH

SEQ ID NO: 251954 - protein, 25 aa, Homo sapiens
  Native (MAGC1_HUMAN)
QIPVSSSSSSTLLSLFQSSPERTHS

SEQ ID NO: 251955 - protein, 20 aa, Homo sapiens
  Native (MAGC1_HUMAN)
QIVPSLPEWEDSLSPHYFPQ

SEQ ID NO: 251956 - protein, 14 aa, Homo sapiens
  Native (MAGC1_HUMAN)
QNPASSFFSSALLS

SEQ ID NO: 251957 - protein, 15 aa, Homo sapiens
  Native (MAGC1_HUMAN)
QNPASSFFSSALLSI

SEQ ID NO: 251958 - protein, 16 aa, Homo sapiens
  Native (MAGC1_HUMAN)
QNPASSFFSSALLSIF

SEQ ID NO: 251959 - protein, 17 aa, Homo sapiens
  Native (MAGC1_HUMAN)
QNPASSFFSSALLSIFQ

SEQ ID NO: 251960 - protein, 18 aa, Homo sapiens
  Native (MAGC1_HUMAN)
QNPASSFFSSALLSIFQS

SEQ ID NO: 251961 - protein, 19 aa, Homo sapiens
  Native (MAGC1_HUMAN)
QNPASSFFSSALLSIFQSS

SEQ ID NO: 251962 - protein, 20 aa, Homo sapiens
  Native (MAGC1_HUMAN)
QNPASSFFSSALLSIFQSSP

SEQ ID NO: 251963 - protein, 21 aa, Homo sapiens
  Native (MAGC1_HUMAN)
QNPASSFFSSALLSIFQSSPE

SEQ ID NO: 251964 - protein, 22 aa, Homo sapiens
  Native (MAGC1_HUMAN)
QNPASSFFSSALLSIFQSSPES

SEQ ID NO: 251965 - protein, 23 aa, Homo sapiens
  Native (MAGC1_HUMAN)
QNPASSFFSSALLSIFQSSPEST

SEQ ID NO: 251966 - protein, 24 aa, Homo sapiens
  Native (MAGC1_HUMAN)
QNPASSFFSSALLSIFQSSPESTQ

SEQ ID NO: 251967 - protein, 25 aa, Homo sapiens
  Native (MAGC1_HUMAN)
QNPASSFFSSALLSIFQSSPESTQS

SEQ ID NO: 251968 - protein, 13 aa, Homo sapiens
  Native (MAGC1_HUMAN)
QNRLLILILSIIF

SEQ ID NO: 251969 - protein, 14 aa, Homo sapiens
  Native (MAGC1_HUMAN)
QNRLLILILSIIFI

SEQ ID NO: 251970 - protein, 15 aa, Homo sapiens
  Native (MAGC1_HUMAN)
QNRLLILILSIIFIK

SEQ ID NO: 251971 - protein, 16 aa, Homo sapiens
  Native (MAGC1_HUMAN)
QNRLLILILSIIFIKG

SEQ ID NO: 251972 - protein, 17 aa, Homo sapiens
  Native (MAGC1_HUMAN)
QNRLLILILSIIFIKGT

SEQ ID NO: 251973 - protein, 18 aa, Homo sapiens
  Native (MAGC1_HUMAN)
QNRLLILILSIIFIKGTY

SEQ ID NO: 251974 - protein, 19 aa, Homo sapiens
  Native (MAGC1_HUMAN)
QNRLLILILSIIFIKGTYA

SEQ ID NO: 251975 - protein, 20 aa, Homo sapiens
  Native (MAGC1_HUMAN)
QNRLLILILSIIFIKGTYAS

SEQ ID NO: 251976 - protein, 21 aa, Homo sapiens
  Native (MAGC1_HUMAN)
QNRLLILILSIIFIKGTYASE

SEQ ID NO: 251977 - protein, 22 aa, Homo sapiens
  Native (MAGC1_HUMAN)
QNRLLILILSIIFIKGTYASEE

SEQ ID NO: 251978 - protein, 23 aa, Homo sapiens
  Native (MAGC1_HUMAN)
QNRLLILILSIIFIKGTYASEEV

SEQ ID NO: 251979 - protein, 24 aa, Homo sapiens
  Native (MAGC1_HUMAN)
QNRLLILILSIIFIKGTYASEEVI

SEQ ID NO: 251980 - protein, 25 aa, Homo sapiens
  Native (MAGC1_HUMAN)
QNRLLILILSIIFIKGTYASEEVIW

SEQ ID NO: 251981 - protein, 14 aa, Homo sapiens
  Native (MAGC1_HUMAN)
QPITKAEMLTNVIS

SEQ ID NO: 251982 - protein, 15 aa, Homo sapiens
  Native (MAGC1_HUMAN)
QPITKAEMLTNVISR

SEQ ID NO: 251983 - protein, 16 aa, Homo sapiens
  Native (MAGC1_HUMAN)
QPITKAEMLTNVISRY

SEQ ID NO: 251984 - protein, 17 aa, Homo sapiens
  Native (MAGC1_HUMAN)
QPITKAEMLTNVISRYT

SEQ ID NO: 251985 - protein, 18 aa, Homo sapiens
  Native (MAGC1_HUMAN)
QPITKAEMLTNVISRYTG

SEQ ID NO: 251986 - protein, 19 aa, Homo sapiens
  Native (MAGC1_HUMAN)
QPITKAEMLTNVISRYTGY

SEQ ID NO: 251987 - protein, 20 aa, Homo sapiens
  Native (MAGC1_HUMAN)
QPITKAEMLTNVISRYTGYF

SEQ ID NO: 251988 - protein, 21 aa, Homo sapiens
  Native (MAGC1_HUMAN)
QPITKAEMLTNVISRYTGYFP

SEQ ID NO: 251989 - protein, 22 aa, Homo sapiens
  Native (MAGC1_HUMAN)
QPITKAEMLTNVISRYTGYFPV

SEQ ID NO: 251990 - protein, 23 aa, Homo sapiens
  Native (MAGC1_HUMAN)
QPITKAEMLTNVISRYTGYFPVI

SEQ ID NO: 251991 - protein, 24 aa, Homo sapiens
  Native (MAGC1_HUMAN)
QPITKAEMLTNVISRYTGYFPVIF

SEQ ID NO: 251992 - protein, 25 aa, Homo sapiens
  Native (MAGC1_HUMAN)
QPITKAEMLTNVISRYTGYFPVIFR

SEQ ID NO: 251993 - protein, 13 aa, Homo sapiens
  Native (MAGC1_HUMAN)
QRPVSSFFSYTLA

SEQ ID NO: 251994 - protein, 14 aa, Homo sapiens
  Native (MAGC1_HUMAN)
QRPVSSFFSYTLAS

SEQ ID NO: 251995 - protein, 15 aa, Homo sapiens
  Native (MAGC1_HUMAN)
QRPVSSFFSYTLASL

SEQ ID NO: 251996 - protein, 16 aa, Homo sapiens
  Native (MAGC1_HUMAN)
QRPVSSFFSYTLASLL

SEQ ID NO: 251997 - protein, 17 aa, Homo sapiens
  Native (MAGC1_HUMAN)
QRPVSSFFSYTLASLLQ

SEQ ID NO: 251998 - protein, 18 aa, Homo sapiens
  Native (MAGC1_HUMAN)
QRPVSSFFSYTLASLLQS

SEQ ID NO: 251999 - protein, 19 aa, Homo sapiens
  Native (MAGC1_HUMAN)
QRPVSSFFSYTLASLLQSS

SEQ ID NO: 252000 - protein, 20 aa, Homo sapiens
  Native (MAGC1_HUMAN)
QRPVSSFFSYTLASLLQSSH

SEQ ID NO: 252001 - protein, 21 aa, Homo sapiens
  Native (MAGC1_HUMAN)
QRPVSSFFSYTLASLLQSSHE

SEQ ID NO: 252002 - protein, 22 aa, Homo sapiens
  Native (MAGC1_HUMAN)
QRPVSSFFSYTLASLLQSSHES

SEQ ID NO: 252003 - protein, 23 aa, Homo sapiens
  Native (MAGC1_HUMAN)
QRPVSSFFSYTLASLLQSSHESP

SEQ ID NO: 252004 - protein, 24 aa, Homo sapiens
  Native (MAGC1_HUMAN)
QRPVSSFFSYTLASLLQSSHESPQ

SEQ ID NO: 252005 - protein, 25 aa, Homo sapiens
  Native (MAGC1_HUMAN)
QRPVSSFFSYTLASLLQSSHESPQS

SEQ ID NO: 252006 - protein, 14 aa, Homo sapiens
  Native (MAGC1_HUMAN)
QSAFEGFPQSPLQI

SEQ ID NO: 252007 - protein, 15 aa, Homo sapiens
  Native (MAGC1_HUMAN)
QSAFEGFPQSPLQIP

SEQ ID NO: 252008 - protein, 16 aa, Homo sapiens
  Native (MAGC1_HUMAN)
QSAFEGFPQSPLQIPV

SEQ ID NO: 252009 - protein, 17 aa, Homo sapiens
  Native (MAGC1_HUMAN)
QSAFEGFPQSPLQIPVS

SEQ ID NO: 252010 - protein, 19 aa, Homo sapiens
  Native (MAGC1_HUMAN)
QSAFEGFPQSPLQIPVSSS

SEQ ID NO: 252011 - protein, 20 aa, Homo sapiens
  Native (MAGC1_HUMAN)
QSAFEGFPQSPLQIPVSSSF

SEQ ID NO: 252012 - protein, 21 aa, Homo sapiens
  Native (MAGC1_HUMAN)
QSAFEGFPQSPLQIPVSSSFS

SEQ ID NO: 252013 - protein, 22 aa, Homo sapiens
  Native (MAGC1_HUMAN)
QSAFEGFPQSPLQIPVSSSFSY

SEQ ID NO: 252014 - protein, 23 aa, Homo sapiens
  Native (MAGC1_HUMAN)
QSAFEGFPQSPLQIPVSSSFSYT

SEQ ID NO: 252015 - protein, 24 aa, Homo sapiens
  Native (MAGC1_HUMAN)
QSAFEGFPQSPLQIPVSSSFSYTL

SEQ ID NO: 252016 - protein, 25 aa, Homo sapiens
  Native (MAGC1_HUMAN)
QSAFEGFPQSPLQIPVSSSFSYTLL

SEQ ID NO: 252017 - protein, 15 aa, Homo sapiens
  Native (MAGC1_HUMAN)
QSFSERTQSTFEGFA

SEQ ID NO: 252018 - protein, 16 aa, Homo sapiens
  Native (MAGC1_HUMAN)
QSFSERTQSTFEGFAQ

SEQ ID NO: 252019 - protein, 17 aa, Homo sapiens
  Native (MAGC1_HUMAN)
QSFSERTQSTFEGFAQS

SEQ ID NO: 252020 - protein, 19 aa, Homo sapiens
  Native (MAGC1_HUMAN)
QSFSERTQSTFEGFAQSSL

SEQ ID NO: 252021 - protein, 20 aa, Homo sapiens
  Native (MAGC1_HUMAN)
QSFSERTQSTFEGFAQSSLQ

SEQ ID NO: 252022 - protein, 21 aa, Homo sapiens
  Native (MAGC1_HUMAN)
QSFSERTQSTFEGFAQSSLQI

SEQ ID NO: 252023 - protein, 22 aa, Homo sapiens
  Native (MAGC1_HUMAN)
QSFSERTQSTFEGFAQSSLQIP

SEQ ID NO: 252024 - protein, 23 aa, Homo sapiens
  Native (MAGC1_HUMAN)
QSFSERTQSTFEGFAQSSLQIPV

SEQ ID NO: 252025 - protein, 24 aa, Homo sapiens
  Native (MAGC1_HUMAN)
QSFSERTQSTFEGFAQSSLQIPVS

SEQ ID NO: 252026 - protein, 25 aa, Homo sapiens
  Native (MAGC1_HUMAN)
QSFSERTQSTFEGFAQSSLQIPVSP

SEQ ID NO: 252027 - protein, 13 aa, Homo sapiens
  Native (MAGC1_HUMAN)
QSLLQIPMTSSFS

SEQ ID NO: 252028 - protein, 14 aa, Homo sapiens
  Native (MAGC1_HUMAN)
QSLLQIPMTSSFSS

SEQ ID NO: 252029 - protein, 15 aa, Homo sapiens
  Native (MAGC1_HUMAN)
QSLLQIPMTSSFSST

SEQ ID NO: 252030 - protein, 16 aa, Homo sapiens
  Native (MAGC1_HUMAN)
QSLLQIPMTSSFSSTL

SEQ ID NO: 252031 - protein, 17 aa, Homo sapiens
  Native (MAGC1_HUMAN)
QSLLQIPMTSSFSSTLL

SEQ ID NO: 252032 - protein, 18 aa, Homo sapiens
  Native (MAGC1_HUMAN)
QSLLQIPMTSSFSSTLLS

SEQ ID NO: 252033 - protein, 19 aa, Homo sapiens
  Native (MAGC1_HUMAN)
QSLLQIPMTSSFSSTLLSI

SEQ ID NO: 252034 - protein, 20 aa, Homo sapiens
  Native (MAGC1_HUMAN)
QSLLQIPMTSSFSSTLLSIF

SEQ ID NO: 252035 - protein, 21 aa, Homo sapiens
  Native (MAGC1_HUMAN)
QSLLQIPMTSSFSSTLLSIFQ

SEQ ID NO: 252036 - protein, 22 aa, Homo sapiens
  Native (MAGC1_HUMAN)
QSLLQIPMTSSFSSTLLSIFQS

SEQ ID NO: 252037 - protein, 23 aa, Homo sapiens
  Native (MAGC1_HUMAN)
QSLLQIPMTSSFSSTLLSIFQSS

SEQ ID NO: 252038 - protein, 24 aa, Homo sapiens
  Native (MAGC1_HUMAN)
QSLLQIPMTSSFSSTLLSIFQSSP

SEQ ID NO: 252039 - protein, 25 aa, Homo sapiens
  Native (MAGC1_HUMAN)
QSLLQIPMTSSFSSTLLSIFQSSPE

SEQ ID NO: 252040 - protein, 23 aa, Homo sapiens
  Native (MAGC1_HUMAN)
QSPESAPEGEDSLSPLQIPQSPL

SEQ ID NO: 252041 - protein, 24 aa, Homo sapiens
  Native (MAGC1_HUMAN)
QSPESAPEGEDSLSPLQIPQSPLE

SEQ ID NO: 252042 - protein, 25 aa, Homo sapiens
  Native (MAGC1_HUMAN)
QSPESAPEGEDSLSPLQIPQSPLEG

SEQ ID NO: 252043 - protein, 14 aa, Homo sapiens
  Native (MAGC1_HUMAN)
QSPFEGFPQSPLQI

SEQ ID NO: 252044 - protein, 15 aa, Homo sapiens
  Native (MAGC1_HUMAN)
QSPFEGFPQSPLQIP

SEQ ID NO: 252045 - protein, 16 aa, Homo sapiens
  Native (MAGC1_HUMAN)
QSPFEGFPQSPLQIPV

SEQ ID NO: 252046 - protein, 17 aa, Homo sapiens
  Native (MAGC1_HUMAN)
QSPFEGFPQSPLQIPVS

SEQ ID NO: 252047 - protein, 19 aa, Homo sapiens
  Native (MAGC1_HUMAN)
QSPFEGFPQSPLQIPVSRS

SEQ ID NO: 252048 - protein, 20 aa, Homo sapiens
  Native (MAGC1_HUMAN)
QSPFEGFPQSPLQIPVSRSF

SEQ ID NO: 252049 - protein, 21 aa, Homo sapiens
  Native (MAGC1_HUMAN)
QSPFEGFPQSPLQIPVSRSFS

SEQ ID NO: 252050 - protein, 22 aa, Homo sapiens
  Native (MAGC1_HUMAN)
QSPFEGFPQSPLQIPVSRSFSS

SEQ ID NO: 252051 - protein, 23 aa, Homo sapiens
  Native (MAGC1_HUMAN)
QSPFEGFPQSPLQIPVSRSFSST

SEQ ID NO: 252052 - protein, 24 aa, Homo sapiens
  Native (MAGC1_HUMAN)
QSPFEGFPQSPLQIPVSRSFSSTL

SEQ ID NO: 252053 - protein, 25 aa, Homo sapiens
  Native (MAGC1_HUMAN)
QSPFEGFPQSPLQIPVSRSFSSTLL

SEQ ID NO: 252054 - protein, 14 aa, Homo sapiens
  Native (MAGC1_HUMAN)
QSPFEGFPQSVLQI

SEQ ID NO: 252055 - protein, 15 aa, Homo sapiens
  Native (MAGC1_HUMAN)
QSPFEGFPQSVLQIP

SEQ ID NO: 252056 - protein, 16 aa, Homo sapiens
  Native (MAGC1_HUMAN)
QSPFEGFPQSVLQIPV

SEQ ID NO: 252057 - protein, 17 aa, Homo sapiens
  Native (MAGC1_HUMAN)
QSPFEGFPQSVLQIPVS

SEQ ID NO: 252058 - protein, 18 aa, Homo sapiens
  Native (MAGC1_HUMAN)
QSPFEGFPQSVLQIPVSA

SEQ ID NO: 252059 - protein, 19 aa, Homo sapiens
  Native (MAGC1_HUMAN)
QSPFEGFPQSVLQIPVSAA

SEQ ID NO: 252060 - protein, 20 aa, Homo sapiens
  Native (MAGC1_HUMAN)
QSPFEGFPQSVLQIPVSAAS

SEQ ID NO: 252061 - protein, 21 aa, Homo sapiens
  Native (MAGC1_HUMAN)
QSPFEGFPQSVLQIPVSAASS

SEQ ID NO: 252062 - protein, 22 aa, Homo sapiens
  Native (MAGC1_HUMAN)
QSPFEGFPQSVLQIPVSAASSS

SEQ ID NO: 252063 - protein, 23 aa, Homo sapiens
  Native (MAGC1_HUMAN)
QSPFEGFPQSVLQIPVSAASSST

SEQ ID NO: 252064 - protein, 24 aa, Homo sapiens
  Native (MAGC1_HUMAN)
QSPFEGFPQSVLQIPVSAASSSTL

SEQ ID NO: 252065 - protein, 25 aa, Homo sapiens
  Native (MAGC1_HUMAN)
QSPFEGFPQSVLQIPVSAASSSTLV

SEQ ID NO: 252066 - protein, 15 aa, Homo sapiens
  Native (MAGC1_HUMAN)
QSPLEGEDSLSSLHF

SEQ ID NO: 252067 - protein, 19 aa, Homo sapiens
  Native (MAGC1_HUMAN)
QSPLEGEDSLSSLHFPQSP

SEQ ID NO: 252068 - protein, 20 aa, Homo sapiens
  Native (MAGC1_HUMAN)
QSPLEGEDSLSSLHFPQSPP

SEQ ID NO: 252069 - protein, 21 aa, Homo sapiens
  Native (MAGC1_HUMAN)
QSPLEGEDSLSSLHFPQSPPE

SEQ ID NO: 252070 - protein, 22 aa, Homo sapiens
  Native (MAGC1_HUMAN)
QSPLEGEDSLSSLHFPQSPPEW

SEQ ID NO: 252071 - protein, 23 aa, Homo sapiens
  Native (MAGC1_HUMAN)
QSPLEGEDSLSSLHFPQSPPEWE

SEQ ID NO: 252072 - protein, 24 aa, Homo sapiens
  Native (MAGC1_HUMAN)
QSPLEGEDSLSSLHFPQSPPEWED

SEQ ID NO: 252073 - protein, 25 aa, Homo sapiens
  Native (MAGC1_HUMAN)
QSPLEGEDSLSSLHFPQSPPEWEDS

SEQ ID NO: 252074 - protein, 13 aa, Homo sapiens
  Native (MAGC1_HUMAN)
QSPLQGEEFQSSL

SEQ ID NO: 252075 - protein, 14 aa, Homo sapiens
  Native (MAGC1_HUMAN)
QSPLQGEEFQSSLQ

SEQ ID NO: 252076 - protein, 15 aa, Homo sapiens
  Native (MAGC1_HUMAN)
QSPLQGEEFQSSLQS

SEQ ID NO: 252077 - protein, 16 aa, Homo sapiens
  Native (MAGC1_HUMAN)
QSPLQGEEFQSSLQSP

SEQ ID NO: 252078 - protein, 17 aa, Homo sapiens
  Native (MAGC1_HUMAN)
QSPLQGEEFQSSLQSPV

SEQ ID NO: 252079 - protein, 18 aa, Homo sapiens
  Native (MAGC1_HUMAN)
QSPLQGEEFQSSLQSPVS

SEQ ID NO: 252080 - protein, 19 aa, Homo sapiens
  Native (MAGC1_HUMAN)
QSPLQGEEFQSSLQSPVSI

SEQ ID NO: 252081 - protein, 20 aa, Homo sapiens
  Native (MAGC1_HUMAN)
QSPLQGEEFQSSLQSPVSIC

SEQ ID NO: 252082 - protein, 21 aa, Homo sapiens
  Native (MAGC1_HUMAN)
QSPLQGEEFQSSLQSPVSICS

SEQ ID NO: 252083 - protein, 22 aa, Homo sapiens
  Native (MAGC1_HUMAN)
QSPLQGEEFQSSLQSPVSICSS

SEQ ID NO: 252084 - protein, 23 aa, Homo sapiens
  Native (MAGC1_HUMAN)
QSPLQGEEFQSSLQSPVSICSSS

SEQ ID NO: 252085 - protein, 24 aa, Homo sapiens
  Native (MAGC1_HUMAN)
QSPLQGEEFQSSLQSPVSICSSST

SEQ ID NO: 252086 - protein, 25 aa, Homo sapiens
  Native (MAGC1_HUMAN)
QSPLQGEEFQSSLQSPVSICSSSTP

SEQ ID NO: 252087 - protein, 14 aa, Homo sapiens
  Native (MAGC1_HUMAN)
QSPLQIPGSPSFSS

SEQ ID NO: 252088 - protein, 15 aa, Homo sapiens
  Native (MAGC1_HUMAN)
QSPLQIPGSPSFSST

SEQ ID NO: 252089 - protein, 16 aa, Homo sapiens
  Native (MAGC1_HUMAN)
QSPLQIPGSPSFSSTL

SEQ ID NO: 252090 - protein, 17 aa, Homo sapiens
  Native (MAGC1_HUMAN)
QSPLQIPGSPSFSSTLL

SEQ ID NO: 252091 - protein, 18 aa, Homo sapiens
  Native (MAGC1_HUMAN)
QSPLQIPGSPSFSSTLLS

SEQ ID NO: 252092 - protein, 19 aa, Homo sapiens
  Native (MAGC1_HUMAN)
QSPLQIPGSPSFSSTLLSL

SEQ ID NO: 252093 - protein, 20 aa, Homo sapiens
  Native (MAGC1_HUMAN)
QSPLQIPGSPSFSSTLLSLF

SEQ ID NO: 252094 - protein, 21 aa, Homo sapiens
  Native (MAGC1_HUMAN)
QSPLQIPGSPSFSSTLLSLFQ

SEQ ID NO: 252095 - protein, 22 aa, Homo sapiens
  Native (MAGC1_HUMAN)
QSPLQIPGSPSFSSTLLSLFQS

SEQ ID NO: 252096 - protein, 23 aa, Homo sapiens
  Native (MAGC1_HUMAN)
QSPLQIPGSPSFSSTLLSLFQSS

SEQ ID NO: 252097 - protein, 24 aa, Homo sapiens
  Native (MAGC1_HUMAN)
QSPLQIPGSPSFSSTLLSLFQSSP

SEQ ID NO: 252098 - protein, 25 aa, Homo sapiens
  Native (MAGC1_HUMAN)
QSPLQIPGSPSFSSTLLSLFQSSPE

SEQ ID NO: 252099 - protein, 15 aa, Homo sapiens
  Native (MAGC1_HUMAN)
QSPLQIPMTSSFSST

SEQ ID NO: 252100 - protein, 16 aa, Homo sapiens
  Native (MAGC1_HUMAN)
QSPLQIPMTSSFSSTL

SEQ ID NO: 252101 - protein, 17 aa, Homo sapiens
  Native (MAGC1_HUMAN)
QSPLQIPMTSSFSSTLL

SEQ ID NO: 252102 - protein, 18 aa, Homo sapiens
  Native (MAGC1_HUMAN)
QSPLQIPMTSSFSSTLLS

SEQ ID NO: 252103 - protein, 19 aa, Homo sapiens
  Native (MAGC1_HUMAN)
QSPLQIPMTSSFSSTLLSI

SEQ ID NO: 252104 - protein, 20 aa, Homo sapiens
  Native (MAGC1_HUMAN)
QSPLQIPMTSSFSSTLLSIL

SEQ ID NO: 252105 - protein, 21 aa, Homo sapiens
  Native (MAGC1_HUMAN)
QSPLQIPMTSSFSSTLLSILQ

SEQ ID NO: 252106 - protein, 22 aa, Homo sapiens
  Native (MAGC1_HUMAN)
QSPLQIPMTSSFSSTLLSILQS

SEQ ID NO: 252107 - protein, 23 aa, Homo sapiens
  Native (MAGC1_HUMAN)
QSPLQIPMTSSFSSTLLSILQSS

SEQ ID NO: 252108 - protein, 24 aa, Homo sapiens
  Native (MAGC1_HUMAN)
QSPLQIPMTSSFSSTLLSILQSSP

SEQ ID NO: 252109 - protein, 25 aa, Homo sapiens
  Native (MAGC1_HUMAN)
QSPLQIPMTSSFSSTLLSILQSSPE

SEQ ID NO: 252110 - protein, 15 aa, Homo sapiens
  Native (MAGC1_HUMAN)
QSPLQIPVSPSSSST

SEQ ID NO: 252111 - protein, 16 aa, Homo sapiens
  Native (MAGC1_HUMAN)
QSPLQIPVSPSSSSTL

SEQ ID NO: 252112 - protein, 17 aa, Homo sapiens
  Native (MAGC1_HUMAN)
QSPLQIPVSPSSSSTLL

SEQ ID NO: 252113 - protein, 18 aa, Homo sapiens
  Native (MAGC1_HUMAN)
QSPLQIPVSPSSSSTLLS

SEQ ID NO: 252114 - protein, 19 aa, Homo sapiens
  Native (MAGC1_HUMAN)
QSPLQIPVSPSSSSTLLSL

SEQ ID NO: 252115 - protein, 20 aa, Homo sapiens
  Native (MAGC1_HUMAN)
QSPLQIPVSPSSSSTLLSLF

SEQ ID NO: 252116 - protein, 21 aa, Homo sapiens
  Native (MAGC1_HUMAN)
QSPLQIPVSPSSSSTLLSLFQ

SEQ ID NO: 252117 - protein, 22 aa, Homo sapiens
  Native (MAGC1_HUMAN)
QSPLQIPVSPSSSSTLLSLFQS

SEQ ID NO: 252118 - protein, 23 aa, Homo sapiens
  Native (MAGC1_HUMAN)
QSPLQIPVSPSSSSTLLSLFQSF

SEQ ID NO: 252119 - protein, 24 aa, Homo sapiens
  Native (MAGC1_HUMAN)
QSPLQIPVSPSSSSTLLSLFQSFS

SEQ ID NO: 252120 - protein, 25 aa, Homo sapiens
  Native (MAGC1_HUMAN)
QSPLQIPVSPSSSSTLLSLFQSFSE

SEQ ID NO: 252121 - protein, 15 aa, Homo sapiens
  Native (MAGC1_HUMAN)
QSPLQIPVSRSFSST

SEQ ID NO: 252122 - protein, 16 aa, Homo sapiens
  Native (MAGC1_HUMAN)
QSPLQIPVSRSFSSTL

SEQ ID NO: 252123 - protein, 17 aa, Homo sapiens
  Native (MAGC1_HUMAN)
QSPLQIPVSRSFSSTLL

SEQ ID NO: 252124 - protein, 18 aa, Homo sapiens
  Native (MAGC1_HUMAN)
QSPLQIPVSRSFSSTLLS

SEQ ID NO: 252125 - protein, 19 aa, Homo sapiens
  Native (MAGC1_HUMAN)
QSPLQIPVSRSFSSTLLSI

SEQ ID NO: 252126 - protein, 20 aa, Homo sapiens
  Native (MAGC1_HUMAN)
QSPLQIPVSRSFSSTLLSIF

SEQ ID NO: 252127 - protein, 21 aa, Homo sapiens
  Native (MAGC1_HUMAN)
QSPLQIPVSRSFSSTLLSIFQ

SEQ ID NO: 252128 - protein, 22 aa, Homo sapiens
  Native (MAGC1_HUMAN)
QSPLQIPVSRSFSSTLLSIFQS

SEQ ID NO: 252129 - protein, 23 aa, Homo sapiens
  Native (MAGC1_HUMAN)
QSPLQIPVSRSFSSTLLSIFQSS

SEQ ID NO: 252130 - protein, 24 aa, Homo sapiens
  Native (MAGC1_HUMAN)
QSPLQIPVSRSFSSTLLSIFQSSP

SEQ ID NO: 252131 - protein, 25 aa, Homo sapiens
  Native (MAGC1_HUMAN)
QSPLQIPVSRSFSSTLLSIFQSSPE

SEQ ID NO: 252132 - protein, 15 aa, Homo sapiens
  Native (MAGC1_HUMAN)
QSPLQIPVSSSFSYT

SEQ ID NO: 252133 - protein, 16 aa, Homo sapiens
  Native (MAGC1_HUMAN)
QSPLQIPVSSSFSYTL

SEQ ID NO: 252134 - protein, 17 aa, Homo sapiens
  Native (MAGC1_HUMAN)
QSPLQIPVSSSFSYTLL

SEQ ID NO: 252135 - protein, 18 aa, Homo sapiens
  Native (MAGC1_HUMAN)
QSPLQIPVSSSFSYTLLS

SEQ ID NO: 252136 - protein, 19 aa, Homo sapiens
  Native (MAGC1_HUMAN)
QSPLQIPVSSSFSYTLLSL

SEQ ID NO: 252137 - protein, 20 aa, Homo sapiens
  Native (MAGC1_HUMAN)
QSPLQIPVSSSFSYTLLSLF

SEQ ID NO: 252138 - protein, 21 aa, Homo sapiens
  Native (MAGC1_HUMAN)
QSPLQIPVSSSFSYTLLSLFQ

SEQ ID NO: 252139 - protein, 22 aa, Homo sapiens
  Native (MAGC1_HUMAN)
QSPLQIPVSSSFSYTLLSLFQS

SEQ ID NO: 252140 - protein, 23 aa, Homo sapiens
  Native (MAGC1_HUMAN)
QSPLQIPVSSSFSYTLLSLFQSS

SEQ ID NO: 252141 - protein, 24 aa, Homo sapiens
  Native (MAGC1_HUMAN)
QSPLQIPVSSSFSYTLLSLFQSSP

SEQ ID NO: 252142 - protein, 25 aa, Homo sapiens
  Native (MAGC1_HUMAN)
QSPLQIPVSSSFSYTLLSLFQSSPE

SEQ ID NO: 252143 - protein, 15 aa, Homo sapiens
  Native (MAGC1_HUMAN)
QSPLQIPVSSSSSSS

SEQ ID NO: 252144 - protein, 16 aa, Homo sapiens
  Native (MAGC1_HUMAN)
QSPLQIPVSSSSSSST

SEQ ID NO: 252145 - protein, 17 aa, Homo sapiens
  Native (MAGC1_HUMAN)
QSPLQIPVSSSSSSSTL

SEQ ID NO: 252146 - protein, 18 aa, Homo sapiens
  Native (MAGC1_HUMAN)
QSPLQIPVSSSSSSSTLL

SEQ ID NO: 252147 - protein, 19 aa, Homo sapiens
  Native (MAGC1_HUMAN)
QSPLQIPVSSSSSSSTLLS

SEQ ID NO: 252148 - protein, 20 aa, Homo sapiens
  Native (MAGC1_HUMAN)
QSPLQIPVSSSSSSSTLLSL

SEQ ID NO: 252149 - protein, 21 aa, Homo sapiens
  Native (MAGC1_HUMAN)
QSPLQIPVSSSSSSSTLLSLF

SEQ ID NO: 252150 - protein, 22 aa, Homo sapiens
  Native (MAGC1_HUMAN)
QSPLQIPVSSSSSSSTLLSLFQ

SEQ ID NO: 252151 - protein, 23 aa, Homo sapiens
  Native (MAGC1_HUMAN)
QSPLQIPVSSSSSSSTLLSLFQS

SEQ ID NO: 252152 - protein, 24 aa, Homo sapiens
  Native (MAGC1_HUMAN)
QSPLQIPVSSSSSSSTLLSLFQSS

SEQ ID NO: 252153 - protein, 25 aa, Homo sapiens
  Native (MAGC1_HUMAN)
QSPLQIPVSSSSSSSTLLSLFQSSP

SEQ ID NO: 252154 - protein, 15 aa, Homo sapiens
  Native (MAGC1_HUMAN)
QSPLQIPVSSSSSST

SEQ ID NO: 252155 - protein, 16 aa, Homo sapiens
  Native (MAGC1_HUMAN)
QSPLQIPVSSSSSSTL

SEQ ID NO: 252156 - protein, 17 aa, Homo sapiens
  Native (MAGC1_HUMAN)
QSPLQIPVSSSSSSTLL

SEQ ID NO: 252157 - protein, 18 aa, Homo sapiens
  Native (MAGC1_HUMAN)
QSPLQIPVSSSSSSTLLS

SEQ ID NO: 252158 - protein, 19 aa, Homo sapiens
  Native (MAGC1_HUMAN)
QSPLQIPVSSSSSSTLLSL

SEQ ID NO: 252159 - protein, 20 aa, Homo sapiens
  Native (MAGC1_HUMAN)
QSPLQIPVSSSSSSTLLSLF

SEQ ID NO: 252160 - protein, 21 aa, Homo sapiens
  Native (MAGC1_HUMAN)
QSPLQIPVSSSSSSTLLSLFQ

SEQ ID NO: 252161 - protein, 22 aa, Homo sapiens
  Native (MAGC1_HUMAN)
QSPLQIPVSSSSSSTLLSLFQS

SEQ ID NO: 252162 - protein, 23 aa, Homo sapiens
  Native (MAGC1_HUMAN)
QSPLQIPVSSSSSSTLLSLFQSS

SEQ ID NO: 252163 - protein, 24 aa, Homo sapiens
  Native (MAGC1_HUMAN)
QSPLQIPVSSSSSSTLLSLFQSSP

SEQ ID NO: 252164 - protein, 25 aa, Homo sapiens
  Native (MAGC1_HUMAN)
QSPLQIPVSSSSSSTLLSLFQSSPE

SEQ ID NO: 252165 - protein, 15 aa, Homo sapiens
  Native (MAGC1_HUMAN)
QSPLQNPASSFFSSA

SEQ ID NO: 252166 - protein, 16 aa, Homo sapiens
  Native (MAGC1_HUMAN)
QSPLQNPASSFFSSAL

SEQ ID NO: 252167 - protein, 17 aa, Homo sapiens
  Native (MAGC1_HUMAN)
QSPLQNPASSFFSSALL

SEQ ID NO: 252168 - protein, 18 aa, Homo sapiens
  Native (MAGC1_HUMAN)
QSPLQNPASSFFSSALLS

SEQ ID NO: 252169 - protein, 19 aa, Homo sapiens
  Native (MAGC1_HUMAN)
QSPLQNPASSFFSSALLSI

SEQ ID NO: 252170 - protein, 20 aa, Homo sapiens
  Native (MAGC1_HUMAN)
QSPLQNPASSFFSSALLSIF

SEQ ID NO: 252171 - protein, 21 aa, Homo sapiens
  Native (MAGC1_HUMAN)
QSPLQNPASSFFSSALLSIFQ

SEQ ID NO: 252172 - protein, 22 aa, Homo sapiens
  Native (MAGC1_HUMAN)
QSPLQNPASSFFSSALLSIFQS

SEQ ID NO: 252173 - protein, 23 aa, Homo sapiens
  Native (MAGC1_HUMAN)
QSPLQNPASSFFSSALLSIFQSS

SEQ ID NO: 252174 - protein, 24 aa, Homo sapiens
  Native (MAGC1_HUMAN)
QSPLQNPASSFFSSALLSIFQSSP

SEQ ID NO: 252175 - protein, 25 aa, Homo sapiens
  Native (MAGC1_HUMAN)
QSPLQNPASSFFSSALLSIFQSSPE

SEQ ID NO: 252176 - protein, 15 aa, Homo sapiens
  Native (MAGC1_HUMAN)
QSPLQRPVSSFFSYT

SEQ ID NO: 252177 - protein, 16 aa, Homo sapiens
  Native (MAGC1_HUMAN)
QSPLQRPVSSFFSYTL

SEQ ID NO: 252178 - protein, 17 aa, Homo sapiens
  Native (MAGC1_HUMAN)
QSPLQRPVSSFFSYTLA

SEQ ID NO: 252179 - protein, 18 aa, Homo sapiens
  Native (MAGC1_HUMAN)
QSPLQRPVSSFFSYTLAS

SEQ ID NO: 252180 - protein, 19 aa, Homo sapiens
  Native (MAGC1_HUMAN)
QSPLQRPVSSFFSYTLASL

SEQ ID NO: 252181 - protein, 20 aa, Homo sapiens
  Native (MAGC1_HUMAN)
QSPLQRPVSSFFSYTLASLL

SEQ ID NO: 252182 - protein, 21 aa, Homo sapiens
  Native (MAGC1_HUMAN)
QSPLQRPVSSFFSYTLASLLQ

SEQ ID NO: 252183 - protein, 22 aa, Homo sapiens
  Native (MAGC1_HUMAN)
QSPLQRPVSSFFSYTLASLLQS

SEQ ID NO: 252184 - protein, 23 aa, Homo sapiens
  Native (MAGC1_HUMAN)
QSPLQRPVSSFFSYTLASLLQSS

SEQ ID NO: 252185 - protein, 24 aa, Homo sapiens
  Native (MAGC1_HUMAN)
QSPLQRPVSSFFSYTLASLLQSSH

SEQ ID NO: 252186 - protein, 25 aa, Homo sapiens
  Native (MAGC1_HUMAN)
QSPLQRPVSSFFSYTLASLLQSSHE

SEQ ID NO: 252187 - protein, 15 aa, Homo sapiens
  Native (MAGC1_HUMAN)
QSPLQSPVSSFPSST

SEQ ID NO: 252188 - protein, 16 aa, Homo sapiens
  Native (MAGC1_HUMAN)
QSPLQSPVSSFPSSTS

SEQ ID NO: 252189 - protein, 17 aa, Homo sapiens
  Native (MAGC1_HUMAN)
QSPLQSPVSSFPSSTSS

SEQ ID NO: 252190 - protein, 18 aa, Homo sapiens
  Native (MAGC1_HUMAN)
QSPLQSPVSSFPSSTSSS

SEQ ID NO: 252191 - protein, 19 aa, Homo sapiens
  Native (MAGC1_HUMAN)
QSPLQSPVSSFPSSTSSSL

SEQ ID NO: 252192 - protein, 20 aa, Homo sapiens
  Native (MAGC1_HUMAN)
QSPLQSPVSSFPSSTSSSLS

SEQ ID NO: 252193 - protein, 21 aa, Homo sapiens
  Native (MAGC1_HUMAN)
QSPLQSPVSSFPSSTSSSLSQ

SEQ ID NO: 252194 - protein, 22 aa, Homo sapiens
  Native (MAGC1_HUMAN)
QSPLQSPVSSFPSSTSSSLSQS

SEQ ID NO: 252195 - protein, 23 aa, Homo sapiens
  Native (MAGC1_HUMAN)
QSPLQSPVSSFPSSTSSSLSQSS

SEQ ID NO: 252196 - protein, 24 aa, Homo sapiens
  Native (MAGC1_HUMAN)
QSPLQSPVSSFPSSTSSSLSQSSP

SEQ ID NO: 252197 - protein, 25 aa, Homo sapiens
  Native (MAGC1_HUMAN)
QSPLQSPVSSFPSSTSSSLSQSSPV

SEQ ID NO: 252198 - protein, 25 aa, Homo sapiens
  Native (MAGC1_HUMAN)
QSPPEGEDVQSPLQNPASSFFSSAL

SEQ ID NO: 252199 - protein, 19 aa, Homo sapiens
  Native (MAGC1_HUMAN)
QSPPEGENTHSPLQIVPSL

SEQ ID NO: 252200 - protein, 20 aa, Homo sapiens
  Native (MAGC1_HUMAN)
QSPPEGENTHSPLQIVPSLP

SEQ ID NO: 252201 - protein, 21 aa, Homo sapiens
  Native (MAGC1_HUMAN)
QSPPEGENTHSPLQIVPSLPE

SEQ ID NO: 252202 - protein, 22 aa, Homo sapiens
  Native (MAGC1_HUMAN)
QSPPEGENTHSPLQIVPSLPEW

SEQ ID NO: 252203 - protein, 23 aa, Homo sapiens
  Native (MAGC1_HUMAN)
QSPPEGENTHSPLQIVPSLPEWE

SEQ ID NO: 252204 - protein, 24 aa, Homo sapiens
  Native (MAGC1_HUMAN)
QSPPEGENTHSPLQIVPSLPEWED

SEQ ID NO: 252205 - protein, 25 aa, Homo sapiens
  Native (MAGC1_HUMAN)
QSPPEGENTHSPLQIVPSLPEWEDS

SEQ ID NO: 252206 - protein, 20 aa, Homo sapiens
  Native (MAGC1_HUMAN)
QSPPEGMHSQSPLQSPESAP

SEQ ID NO: 252207 - protein, 24 aa, Homo sapiens
  Native (MAGC1_HUMAN)
QSPPEGPAQSPLQRPVSSFFSYTL

SEQ ID NO: 252208 - protein, 25 aa, Homo sapiens
  Native (MAGC1_HUMAN)
QSPPEGPAQSPLQRPVSSFFSYTLA

SEQ ID NO: 252209 - protein, 24 aa, Homo sapiens
  Native (MAGC1_HUMAN)
QSPPEGPAQSPLQSPVSSFPSSTS

SEQ ID NO: 252210 - protein, 25 aa, Homo sapiens
  Native (MAGC1_HUMAN)
QSPPEGPAQSPLQSPVSSFPSSTSS

SEQ ID NO: 252211 - protein, 20 aa, Homo sapiens
  Native (MAGC1_HUMAN)
QSPPEWEDSLSPLHFPQFPP

SEQ ID NO: 252212 - protein, 21 aa, Homo sapiens
  Native (MAGC1_HUMAN)
QSPPEWEDSLSPLHFPQFPPQ

SEQ ID NO: 252213 - protein, 22 aa, Homo sapiens
  Native (MAGC1_HUMAN)
QSPPEWEDSLSPLHFPQFPPQG

SEQ ID NO: 252214 - protein, 23 aa, Homo sapiens
  Native (MAGC1_HUMAN)
QSPPEWEDSLSPLHFPQFPPQGE

SEQ ID NO: 252215 - protein, 24 aa, Homo sapiens
  Native (MAGC1_HUMAN)
QSPPEWEDSLSPLHFPQFPPQGED

SEQ ID NO: 252216 - protein, 25 aa, Homo sapiens
  Native (MAGC1_HUMAN)
QSPPEWEDSLSPLHFPQFPPQGEDF

SEQ ID NO: 252217 - protein, 22 aa, Homo sapiens
  Native (MAGC1_HUMAN)
QSPPQGEDSMSPLYFPQSPLQG

SEQ ID NO: 252218 - protein, 23 aa, Homo sapiens
  Native (MAGC1_HUMAN)
QSPPQGEDSMSPLYFPQSPLQGE

SEQ ID NO: 252219 - protein, 24 aa, Homo sapiens
  Native (MAGC1_HUMAN)
QSPPQGEDSMSPLYFPQSPLQGEE

SEQ ID NO: 252220 - protein, 25 aa, Homo sapiens
  Native (MAGC1_HUMAN)
QSPPQGEDSMSPLYFPQSPLQGEEF

SEQ ID NO: 252221 - protein, 13 aa, Homo sapiens
  Native (MAGC1_HUMAN)
QSPVISFSSSTSL

SEQ ID NO: 252222 - protein, 14 aa, Homo sapiens
  Native (MAGC1_HUMAN)
QSPVISFSSSTSLS

SEQ ID NO: 252223 - protein, 15 aa, Homo sapiens
  Native (MAGC1_HUMAN)
QSPVISFSSSTSLSP

SEQ ID NO: 252224 - protein, 16 aa, Homo sapiens
  Native (MAGC1_HUMAN)
QSPVISFSSSTSLSPF

SEQ ID NO: 252225 - protein, 17 aa, Homo sapiens
  Native (MAGC1_HUMAN)
QSPVISFSSSTSLSPFS

SEQ ID NO: 252226 - protein, 18 aa, Homo sapiens
  Native (MAGC1_HUMAN)
QSPVISFSSSTSLSPFSE

SEQ ID NO: 252227 - protein, 19 aa, Homo sapiens
  Native (MAGC1_HUMAN)
QSPVISFSSSTSLSPFSEE

SEQ ID NO: 252228 - protein, 20 aa, Homo sapiens
  Native (MAGC1_HUMAN)
QSPVISFSSSTSLSPFSEES

SEQ ID NO: 252229 - protein, 21 aa, Homo sapiens
  Native (MAGC1_HUMAN)
QSPVISFSSSTSLSPFSEESS

SEQ ID NO: 252230 - protein, 22 aa, Homo sapiens
  Native (MAGC1_HUMAN)
QSPVISFSSSTSLSPFSEESSS

SEQ ID NO: 252231 - protein, 23 aa, Homo sapiens
  Native (MAGC1_HUMAN)
QSPVISFSSSTSLSPFSEESSSP

SEQ ID NO: 252232 - protein, 24 aa, Homo sapiens
  Native (MAGC1_HUMAN)
QSPVISFSSSTSLSPFSEESSSPV

SEQ ID NO: 252233 - protein, 25 aa, Homo sapiens
  Native (MAGC1_HUMAN)
QSPVISFSSSTSLSPFSEESSSPVD

SEQ ID NO: 252234 - protein, 14 aa, Homo sapiens
  Native (MAGC1_HUMAN)
QSPVSICSSSTPSS

SEQ ID NO: 252235 - protein, 15 aa, Homo sapiens
  Native (MAGC1_HUMAN)
QSPVSICSSSTPSSL

SEQ ID NO: 252236 - protein, 16 aa, Homo sapiens
  Native (MAGC1_HUMAN)
QSPVSICSSSTPSSLP

SEQ ID NO: 252237 - protein, 17 aa, Homo sapiens
  Native (MAGC1_HUMAN)
QSPVSICSSSTPSSLPQ

SEQ ID NO: 252238 - protein, 18 aa, Homo sapiens
  Native (MAGC1_HUMAN)
QSPVSICSSSTPSSLPQS

SEQ ID NO: 252239 - protein, 19 aa, Homo sapiens
  Native (MAGC1_HUMAN)
QSPVSICSSSTPSSLPQSF

SEQ ID NO: 252240 - protein, 20 aa, Homo sapiens
  Native (MAGC1_HUMAN)
QSPVSICSSSTPSSLPQSFP

SEQ ID NO: 252241 - protein, 21 aa, Homo sapiens
  Native (MAGC1_HUMAN)
QSPVSICSSSTPSSLPQSFPE

SEQ ID NO: 252242 - protein, 22 aa, Homo sapiens
  Native (MAGC1_HUMAN)
QSPVSICSSSTPSSLPQSFPES

SEQ ID NO: 252243 - protein, 23 aa, Homo sapiens
  Native (MAGC1_HUMAN)
QSPVSICSSSTPSSLPQSFPESS

SEQ ID NO: 252244 - protein, 24 aa, Homo sapiens
  Native (MAGC1_HUMAN)
QSPVSICSSSTPSSLPQSFPESSQ

SEQ ID NO: 252245 - protein, 25 aa, Homo sapiens
  Native (MAGC1_HUMAN)
QSPVSICSSSTPSSLPQSFPESSQS

SEQ ID NO: 252246 - protein, 14 aa, Homo sapiens
  Native (MAGC1_HUMAN)
QSPVSICSSSTSLS

SEQ ID NO: 252247 - protein, 15 aa, Homo sapiens
  Native (MAGC1_HUMAN)
QSPVSICSSSTSLSL

SEQ ID NO: 252248 - protein, 16 aa, Homo sapiens
  Native (MAGC1_HUMAN)
QSPVSICSSSTSLSLP

SEQ ID NO: 252249 - protein, 17 aa, Homo sapiens
  Native (MAGC1_HUMAN)
QSPVSICSSSTSLSLPQ

SEQ ID NO: 252250 - protein, 18 aa, Homo sapiens
  Native (MAGC1_HUMAN)
QSPVSICSSSTSLSLPQS

SEQ ID NO: 252251 - protein, 19 aa, Homo sapiens
  Native (MAGC1_HUMAN)
QSPVSICSSSTSLSLPQSF

SEQ ID NO: 252252 - protein, 20 aa, Homo sapiens
  Native (MAGC1_HUMAN)
QSPVSICSSSTSLSLPQSFP

SEQ ID NO: 252253 - protein, 21 aa, Homo sapiens
  Native (MAGC1_HUMAN)
QSPVSICSSSTSLSLPQSFPE

SEQ ID NO: 252254 - protein, 22 aa, Homo sapiens
  Native (MAGC1_HUMAN)
QSPVSICSSSTSLSLPQSFPES

SEQ ID NO: 252255 - protein, 23 aa, Homo sapiens
  Native (MAGC1_HUMAN)
QSPVSICSSSTSLSLPQSFPESP

SEQ ID NO: 252256 - protein, 24 aa, Homo sapiens
  Native (MAGC1_HUMAN)
QSPVSICSSSTSLSLPQSFPESPQ

SEQ ID NO: 252257 - protein, 25 aa, Homo sapiens
  Native (MAGC1_HUMAN)
QSPVSICSSSTSLSLPQSFPESPQS

SEQ ID NO: 252258 - protein, 14 aa, Homo sapiens
  Native (MAGC1_HUMAN)
QSPVSSFPSSTSSS

SEQ ID NO: 252259 - protein, 15 aa, Homo sapiens
  Native (MAGC1_HUMAN)
QSPVSSFPSSTSSSL

SEQ ID NO: 252260 - protein, 16 aa, Homo sapiens
  Native (MAGC1_HUMAN)
QSPVSSFPSSTSSSLS

SEQ ID NO: 252261 - protein, 17 aa, Homo sapiens
  Native (MAGC1_HUMAN)
QSPVSSFPSSTSSSLSQ

SEQ ID NO: 252262 - protein, 18 aa, Homo sapiens
  Native (MAGC1_HUMAN)
QSPVSSFPSSTSSSLSQS

SEQ ID NO: 252263 - protein, 19 aa, Homo sapiens
  Native (MAGC1_HUMAN)
QSPVSSFPSSTSSSLSQSS

SEQ ID NO: 252264 - protein, 20 aa, Homo sapiens
  Native (MAGC1_HUMAN)
QSPVSSFPSSTSSSLSQSSP

SEQ ID NO: 252265 - protein, 21 aa, Homo sapiens
  Native (MAGC1_HUMAN)
QSPVSSFPSSTSSSLSQSSPV

SEQ ID NO: 252266 - protein, 22 aa, Homo sapiens
  Native (MAGC1_HUMAN)
QSPVSSFPSSTSSSLSQSSPVS

SEQ ID NO: 252267 - protein, 23 aa, Homo sapiens
  Native (MAGC1_HUMAN)
QSPVSSFPSSTSSSLSQSSPVSS

SEQ ID NO: 252268 - protein, 24 aa, Homo sapiens
  Native (MAGC1_HUMAN)
QSPVSSFPSSTSSSLSQSSPVSSF

SEQ ID NO: 252269 - protein, 25 aa, Homo sapiens
  Native (MAGC1_HUMAN)
QSPVSSFPSSTSSSLSQSSPVSSFP

SEQ ID NO: 252270 - protein, 15 aa, Homo sapiens
  Native (MAGC1_HUMAN)
QSSLQIPVSPSFSST

SEQ ID NO: 252271 - protein, 16 aa, Homo sapiens
  Native (MAGC1_HUMAN)
QSSLQIPVSPSFSSTL

SEQ ID NO: 252272 - protein, 17 aa, Homo sapiens
  Native (MAGC1_HUMAN)
QSSLQIPVSPSFSSTLV

SEQ ID NO: 252273 - protein, 18 aa, Homo sapiens
  Native (MAGC1_HUMAN)
QSSLQIPVSPSFSSTLVS

SEQ ID NO: 252274 - protein, 19 aa, Homo sapiens
  Native (MAGC1_HUMAN)
QSSLQIPVSPSFSSTLVSL

SEQ ID NO: 252275 - protein, 20 aa, Homo sapiens
  Native (MAGC1_HUMAN)
QSSLQIPVSPSFSSTLVSLF

SEQ ID NO: 252276 - protein, 21 aa, Homo sapiens
  Native (MAGC1_HUMAN)
QSSLQIPVSPSFSSTLVSLFQ

SEQ ID NO: 252277 - protein, 22 aa, Homo sapiens
  Native (MAGC1_HUMAN)
QSSLQIPVSPSFSSTLVSLFQS

SEQ ID NO: 252278 - protein, 23 aa, Homo sapiens
  Native (MAGC1_HUMAN)
QSSLQIPVSPSFSSTLVSLFQSS

SEQ ID NO: 252279 - protein, 24 aa, Homo sapiens
  Native (MAGC1_HUMAN)
QSSLQIPVSPSFSSTLVSLFQSSP

SEQ ID NO: 252280 - protein, 25 aa, Homo sapiens
  Native (MAGC1_HUMAN)
QSSLQIPVSPSFSSTLVSLFQSSPE

SEQ ID NO: 252281 - protein, 15 aa, Homo sapiens
  Native (MAGC1_HUMAN)
QSSLQSPVSICSSST

SEQ ID NO: 252282 - protein, 16 aa, Homo sapiens
  Native (MAGC1_HUMAN)
QSSLQSPVSICSSSTP

SEQ ID NO: 252283 - protein, 17 aa, Homo sapiens
  Native (MAGC1_HUMAN)
QSSLQSPVSICSSSTPS

SEQ ID NO: 252284 - protein, 19 aa, Homo sapiens
  Native (MAGC1_HUMAN)
QSSLQSPVSICSSSTPSSL

SEQ ID NO: 252285 - protein, 20 aa, Homo sapiens
  Native (MAGC1_HUMAN)
QSSLQSPVSICSSSTPSSLP

SEQ ID NO: 252286 - protein, 21 aa, Homo sapiens
  Native (MAGC1_HUMAN)
QSSLQSPVSICSSSTPSSLPQ

SEQ ID NO: 252287 - protein, 22 aa, Homo sapiens
  Native (MAGC1_HUMAN)
QSSLQSPVSICSSSTPSSLPQS

SEQ ID NO: 252288 - protein, 23 aa, Homo sapiens
  Native (MAGC1_HUMAN)
QSSLQSPVSICSSSTPSSLPQSF

SEQ ID NO: 252289 - protein, 24 aa, Homo sapiens
  Native (MAGC1_HUMAN)
QSSLQSPVSICSSSTPSSLPQSFP

SEQ ID NO: 252290 - protein, 25 aa, Homo sapiens
  Native (MAGC1_HUMAN)
QSSLQSPVSICSSSTPSSLPQSFPE

SEQ ID NO: 252291 - protein, 16 aa, Homo sapiens
  Native (MAGC1_HUMAN)
QSSLQSPVSICSSSTS

SEQ ID NO: 252292 - protein, 17 aa, Homo sapiens
  Native (MAGC1_HUMAN)
QSSLQSPVSICSSSTSL

SEQ ID NO: 252293 - protein, 18 aa, Homo sapiens
  Native (MAGC1_HUMAN)
QSSLQSPVSICSSSTSLS

SEQ ID NO: 252294 - protein, 19 aa, Homo sapiens
  Native (MAGC1_HUMAN)
QSSLQSPVSICSSSTSLSL

SEQ ID NO: 252295 - protein, 20 aa, Homo sapiens
  Native (MAGC1_HUMAN)
QSSLQSPVSICSSSTSLSLP

SEQ ID NO: 252296 - protein, 21 aa, Homo sapiens
  Native (MAGC1_HUMAN)
QSSLQSPVSICSSSTSLSLPQ

SEQ ID NO: 252297 - protein, 22 aa, Homo sapiens
  Native (MAGC1_HUMAN)
QSSLQSPVSICSSSTSLSLPQS

SEQ ID NO: 252298 - protein, 23 aa, Homo sapiens
  Native (MAGC1_HUMAN)
QSSLQSPVSICSSSTSLSLPQSF

SEQ ID NO: 252299 - protein, 24 aa, Homo sapiens
  Native (MAGC1_HUMAN)
QSSLQSPVSICSSSTSLSLPQSFP

SEQ ID NO: 252300 - protein, 25 aa, Homo sapiens
  Native (MAGC1_HUMAN)
QSSLQSPVSICSSSTSLSLPQSFPE

SEQ ID NO: 252301 - protein, 19 aa, Homo sapiens
  Native (MAGC1_HUMAN)
QSSPECTQSTFEGFPQSPL

SEQ ID NO: 252302 - protein, 20 aa, Homo sapiens
  Native (MAGC1_HUMAN)
QSSPECTQSTFEGFPQSPLQ

SEQ ID NO: 252303 - protein, 21 aa, Homo sapiens
  Native (MAGC1_HUMAN)
QSSPECTQSTFEGFPQSPLQI

SEQ ID NO: 252304 - protein, 22 aa, Homo sapiens
  Native (MAGC1_HUMAN)
QSSPECTQSTFEGFPQSPLQIP

SEQ ID NO: 252305 - protein, 23 aa, Homo sapiens
  Native (MAGC1_HUMAN)
QSSPECTQSTFEGFPQSPLQIPQ

SEQ ID NO: 252306 - protein, 24 aa, Homo sapiens
  Native (MAGC1_HUMAN)
QSSPECTQSTFEGFPQSPLQIPQS

SEQ ID NO: 252307 - protein, 25 aa, Homo sapiens
  Native (MAGC1_HUMAN)
QSSPECTQSTFEGFPQSPLQIPQSP

SEQ ID NO: 252308 - protein, 20 aa, Homo sapiens
  Native (MAGC1_HUMAN)
QSSPEGKDSLSPLEISQSPP

SEQ ID NO: 252309 - protein, 19 aa, Homo sapiens
  Native (MAGC1_HUMAN)
QSSPERTHSTFEGFPQSLL

SEQ ID NO: 252310 - protein, 20 aa, Homo sapiens
  Native (MAGC1_HUMAN)
QSSPERTHSTFEGFPQSLLQ

SEQ ID NO: 252311 - protein, 21 aa, Homo sapiens
  Native (MAGC1_HUMAN)
QSSPERTHSTFEGFPQSLLQI

SEQ ID NO: 252312 - protein, 22 aa, Homo sapiens
  Native (MAGC1_HUMAN)
QSSPERTHSTFEGFPQSLLQIP

SEQ ID NO: 252313 - protein, 23 aa, Homo sapiens
  Native (MAGC1_HUMAN)
QSSPERTHSTFEGFPQSLLQIPM

SEQ ID NO: 252314 - protein, 24 aa, Homo sapiens
  Native (MAGC1_HUMAN)
QSSPERTHSTFEGFPQSLLQIPMT

SEQ ID NO: 252315 - protein, 25 aa, Homo sapiens
  Native (MAGC1_HUMAN)
QSSPERTHSTFEGFPQSLLQIPMTS

SEQ ID NO: 252316 - protein, 19 aa, Homo sapiens
  Native (MAGC1_HUMAN)
QSSPERTHSTFEGFPQSPL

SEQ ID NO: 252317 - protein, 20 aa, Homo sapiens
  Native (MAGC1_HUMAN)
QSSPERTHSTFEGFPQSPLQ

SEQ ID NO: 252318 - protein, 21 aa, Homo sapiens
  Native (MAGC1_HUMAN)
QSSPERTHSTFEGFPQSPLQI

SEQ ID NO: 252319 - protein, 22 aa, Homo sapiens
  Native (MAGC1_HUMAN)
QSSPERTHSTFEGFPQSPLQIP

SEQ ID NO: 252320 - protein, 23 aa, Homo sapiens
  Native (MAGC1_HUMAN)
QSSPERTHSTFEGFPQSPLQIPM

SEQ ID NO: 252321 - protein, 24 aa, Homo sapiens
  Native (MAGC1_HUMAN)
QSSPERTHSTFEGFPQSPLQIPMT

SEQ ID NO: 252322 - protein, 25 aa, Homo sapiens
  Native (MAGC1_HUMAN)
QSSPERTHSTFEGFPQSPLQIPMTS

SEQ ID NO: 252323 - protein, 23 aa, Homo sapiens
  Native (MAGC1_HUMAN)
QSSPERTHSTFEGFPQSPLQIPV

SEQ ID NO: 252324 - protein, 24 aa, Homo sapiens
  Native (MAGC1_HUMAN)
QSSPERTHSTFEGFPQSPLQIPVS

SEQ ID NO: 252325 - protein, 25 aa, Homo sapiens
  Native (MAGC1_HUMAN)
QSSPERTHSTFEGFPQSPLQIPVSS

SEQ ID NO: 252326 - protein, 15 aa, Homo sapiens
  Native (MAGC1_HUMAN)
QSSPERTQSTFEGFA

SEQ ID NO: 252327 - protein, 16 aa, Homo sapiens
  Native (MAGC1_HUMAN)
QSSPERTQSTFEGFAQ

SEQ ID NO: 252328 - protein, 17 aa, Homo sapiens
  Native (MAGC1_HUMAN)
QSSPERTQSTFEGFAQS

SEQ ID NO: 252329 - protein, 19 aa, Homo sapiens
  Native (MAGC1_HUMAN)
QSSPERTQSTFEGFAQSPL

SEQ ID NO: 252330 - protein, 20 aa, Homo sapiens
  Native (MAGC1_HUMAN)
QSSPERTQSTFEGFAQSPLQ

SEQ ID NO: 252331 - protein, 21 aa, Homo sapiens
  Native (MAGC1_HUMAN)
QSSPERTQSTFEGFAQSPLQI

SEQ ID NO: 252332 - protein, 22 aa, Homo sapiens
  Native (MAGC1_HUMAN)
QSSPERTQSTFEGFAQSPLQIP

SEQ ID NO: 252333 - protein, 23 aa, Homo sapiens
  Native (MAGC1_HUMAN)
QSSPERTQSTFEGFAQSPLQIPV

SEQ ID NO: 252334 - protein, 24 aa, Homo sapiens
  Native (MAGC1_HUMAN)
QSSPERTQSTFEGFAQSPLQIPVS

SEQ ID NO: 252335 - protein, 25 aa, Homo sapiens
  Native (MAGC1_HUMAN)
QSSPERTQSTFEGFAQSPLQIPVSP

SEQ ID NO: 252336 - protein, 16 aa, Homo sapiens
  Native (MAGC1_HUMAN)
QSSPERTQSTFEGFPQ

SEQ ID NO: 252337 - protein, 17 aa, Homo sapiens
  Native (MAGC1_HUMAN)
QSSPERTQSTFEGFPQS

SEQ ID NO: 252338 - protein, 19 aa, Homo sapiens
  Native (MAGC1_HUMAN)
QSSPERTQSTFEGFPQSPL

SEQ ID NO: 252339 - protein, 20 aa, Homo sapiens
  Native (MAGC1_HUMAN)
QSSPERTQSTFEGFPQSPLQ

SEQ ID NO: 252340 - protein, 21 aa, Homo sapiens
  Native (MAGC1_HUMAN)
QSSPERTQSTFEGFPQSPLQI

SEQ ID NO: 252341 - protein, 22 aa, Homo sapiens
  Native (MAGC1_HUMAN)
QSSPERTQSTFEGFPQSPLQIP

SEQ ID NO: 252342 - protein, 23 aa, Homo sapiens
  Native (MAGC1_HUMAN)
QSSPERTQSTFEGFPQSPLQIPV

SEQ ID NO: 252343 - protein, 24 aa, Homo sapiens
  Native (MAGC1_HUMAN)
QSSPERTQSTFEGFPQSPLQIPVS

SEQ ID NO: 252344 - protein, 25 aa, Homo sapiens
  Native (MAGC1_HUMAN)
QSSPERTQSTFEGFPQSPLQIPVSS

SEQ ID NO: 252345 - protein, 15 aa, Homo sapiens
  Native (MAGC1_HUMAN)
QSSPESAQSAFEGFP

SEQ ID NO: 252346 - protein, 19 aa, Homo sapiens
  Native (MAGC1_HUMAN)
QSSPESAQSAFEGFPQSPL

SEQ ID NO: 252347 - protein, 20 aa, Homo sapiens
  Native (MAGC1_HUMAN)
QSSPESAQSAFEGFPQSPLQ

SEQ ID NO: 252348 - protein, 21 aa, Homo sapiens
  Native (MAGC1_HUMAN)
QSSPESAQSAFEGFPQSPLQI

SEQ ID NO: 252349 - protein, 22 aa, Homo sapiens
  Native (MAGC1_HUMAN)
QSSPESAQSAFEGFPQSPLQIP

SEQ ID NO: 252350 - protein, 23 aa, Homo sapiens
  Native (MAGC1_HUMAN)
QSSPESAQSAFEGFPQSPLQIPV

SEQ ID NO: 252351 - protein, 24 aa, Homo sapiens
  Native (MAGC1_HUMAN)
QSSPESAQSAFEGFPQSPLQIPVS

SEQ ID NO: 252352 - protein, 25 aa, Homo sapiens
  Native (MAGC1_HUMAN)
QSSPESAQSAFEGFPQSPLQIPVSS

SEQ ID NO: 252353 - protein, 19 aa, Homo sapiens
  Native (MAGC1_HUMAN)
QSSPESAQSTFEGFPQSPL

SEQ ID NO: 252354 - protein, 20 aa, Homo sapiens
  Native (MAGC1_HUMAN)
QSSPESAQSTFEGFPQSPLQ

SEQ ID NO: 252355 - protein, 21 aa, Homo sapiens
  Native (MAGC1_HUMAN)
QSSPESAQSTFEGFPQSPLQI

SEQ ID NO: 252356 - protein, 22 aa, Homo sapiens
  Native (MAGC1_HUMAN)
QSSPESAQSTFEGFPQSPLQIP

SEQ ID NO: 252357 - protein, 23 aa, Homo sapiens
  Native (MAGC1_HUMAN)
QSSPESAQSTFEGFPQSPLQIPG

SEQ ID NO: 252358 - protein, 24 aa, Homo sapiens
  Native (MAGC1_HUMAN)
QSSPESAQSTFEGFPQSPLQIPGS

SEQ ID NO: 252359 - protein, 25 aa, Homo sapiens
  Native (MAGC1_HUMAN)
QSSPESAQSTFEGFPQSPLQIPGSP

SEQ ID NO: 252360 - protein, 19 aa, Homo sapiens
  Native (MAGC1_HUMAN)
QSSPESDDTLYPLQSPQSR

SEQ ID NO: 252361 - protein, 20 aa, Homo sapiens
  Native (MAGC1_HUMAN)
QSSPESDDTLYPLQSPQSRS

SEQ ID NO: 252362 - protein, 21 aa, Homo sapiens
  Native (MAGC1_HUMAN)
QSSPESDDTLYPLQSPQSRSE

SEQ ID NO: 252363 - protein, 22 aa, Homo sapiens
  Native (MAGC1_HUMAN)
QSSPESDDTLYPLQSPQSRSEG

SEQ ID NO: 252364 - protein, 23 aa, Homo sapiens
  Native (MAGC1_HUMAN)
QSSPESDDTLYPLQSPQSRSEGE

SEQ ID NO: 252365 - protein, 24 aa, Homo sapiens
  Native (MAGC1_HUMAN)
QSSPESDDTLYPLQSPQSRSEGED

SEQ ID NO: 252366 - protein, 25 aa, Homo sapiens
  Native (MAGC1_HUMAN)
QSSPESDDTLYPLQSPQSRSEGEDS

SEQ ID NO: 252367 - protein, 20 aa, Homo sapiens
  Native (MAGC1_HUMAN)
QSSPESTQSPFEGFPQSPLQ

SEQ ID NO: 252368 - protein, 21 aa, Homo sapiens
  Native (MAGC1_HUMAN)
QSSPESTQSPFEGFPQSPLQI

SEQ ID NO: 252369 - protein, 22 aa, Homo sapiens
  Native (MAGC1_HUMAN)
QSSPESTQSPFEGFPQSPLQIP

SEQ ID NO: 252370 - protein, 23 aa, Homo sapiens
  Native (MAGC1_HUMAN)
QSSPESTQSPFEGFPQSPLQIPV

SEQ ID NO: 252371 - protein, 24 aa, Homo sapiens
  Native (MAGC1_HUMAN)
QSSPESTQSPFEGFPQSPLQIPVS

SEQ ID NO: 252372 - protein, 25 aa, Homo sapiens
  Native (MAGC1_HUMAN)
QSSPESTQSPFEGFPQSPLQIPVSR

SEQ ID NO: 252373 - protein, 20 aa, Homo sapiens
  Native (MAGC1_HUMAN)
QSSPESTQSPFEGFPQSVLQ

SEQ ID NO: 252374 - protein, 21 aa, Homo sapiens
  Native (MAGC1_HUMAN)
QSSPESTQSPFEGFPQSVLQI

SEQ ID NO: 252375 - protein, 22 aa, Homo sapiens
  Native (MAGC1_HUMAN)
QSSPESTQSPFEGFPQSVLQIP

SEQ ID NO: 252376 - protein, 23 aa, Homo sapiens
  Native (MAGC1_HUMAN)
QSSPESTQSPFEGFPQSVLQIPV

SEQ ID NO: 252377 - protein, 24 aa, Homo sapiens
  Native (MAGC1_HUMAN)
QSSPESTQSPFEGFPQSVLQIPVS

SEQ ID NO: 252378 - protein, 25 aa, Homo sapiens
  Native (MAGC1_HUMAN)
QSSPESTQSPFEGFPQSVLQIPVSA

SEQ ID NO: 252379 - protein, 14 aa, Homo sapiens
  Native (MAGC1_HUMAN)
QSSPVSSFPSSTSS

SEQ ID NO: 252380 - protein, 15 aa, Homo sapiens
  Native (MAGC1_HUMAN)
QSSPVSSFPSSTSSS

SEQ ID NO: 252381 - protein, 16 aa, Homo sapiens
  Native (MAGC1_HUMAN)
QSSPVSSFPSSTSSSL

SEQ ID NO: 252382 - protein, 17 aa, Homo sapiens
  Native (MAGC1_HUMAN)
QSSPVSSFPSSTSSSLS

SEQ ID NO: 252383 - protein, 18 aa, Homo sapiens
  Native (MAGC1_HUMAN)
QSSPVSSFPSSTSSSLSK

SEQ ID NO: 252384 - protein, 19 aa, Homo sapiens
  Native (MAGC1_HUMAN)
QSSPVSSFPSSTSSSLSKS

SEQ ID NO: 252385 - protein, 20 aa, Homo sapiens
  Native (MAGC1_HUMAN)
QSSPVSSFPSSTSSSLSKSS

SEQ ID NO: 252386 - protein, 21 aa, Homo sapiens
  Native (MAGC1_HUMAN)
QSSPVSSFPSSTSSSLSKSSP

SEQ ID NO: 252387 - protein, 22 aa, Homo sapiens
  Native (MAGC1_HUMAN)
QSSPVSSFPSSTSSSLSKSSPE

SEQ ID NO: 252388 - protein, 23 aa, Homo sapiens
  Native (MAGC1_HUMAN)
QSSPVSSFPSSTSSSLSKSSPES

SEQ ID NO: 252389 - protein, 24 aa, Homo sapiens
  Native (MAGC1_HUMAN)
QSSPVSSFPSSTSSSLSKSSPESP

SEQ ID NO: 252390 - protein, 25 aa, Homo sapiens
  Native (MAGC1_HUMAN)
QSSPVSSFPSSTSSSLSKSSPESPL

SEQ ID NO: 252391 - protein, 14 aa, Homo sapiens
  Native (MAGC1_HUMAN)
QSTFEGFAQSPLQI

SEQ ID NO: 252392 - protein, 15 aa, Homo sapiens
  Native (MAGC1_HUMAN)
QSTFEGFAQSPLQIP

SEQ ID NO: 252393 - protein, 16 aa, Homo sapiens
  Native (MAGC1_HUMAN)
QSTFEGFAQSPLQIPV

SEQ ID NO: 252394 - protein, 17 aa, Homo sapiens
  Native (MAGC1_HUMAN)
QSTFEGFAQSPLQIPVS

SEQ ID NO: 252395 - protein, 18 aa, Homo sapiens
  Native (MAGC1_HUMAN)
QSTFEGFAQSPLQIPVSP

SEQ ID NO: 252396 - protein, 19 aa, Homo sapiens
  Native (MAGC1_HUMAN)
QSTFEGFAQSPLQIPVSPS

SEQ ID NO: 252397 - protein, 20 aa, Homo sapiens
  Native (MAGC1_HUMAN)
QSTFEGFAQSPLQIPVSPSS

SEQ ID NO: 252398 - protein, 21 aa, Homo sapiens
  Native (MAGC1_HUMAN)
QSTFEGFAQSPLQIPVSPSSS

SEQ ID NO: 252399 - protein, 22 aa, Homo sapiens
  Native (MAGC1_HUMAN)
QSTFEGFAQSPLQIPVSPSSSS

SEQ ID NO: 252400 - protein, 23 aa, Homo sapiens
  Native (MAGC1_HUMAN)
QSTFEGFAQSPLQIPVSPSSSST

SEQ ID NO: 252401 - protein, 24 aa, Homo sapiens
  Native (MAGC1_HUMAN)
QSTFEGFAQSPLQIPVSPSSSSTL

SEQ ID NO: 252402 - protein, 25 aa, Homo sapiens
  Native (MAGC1_HUMAN)
QSTFEGFAQSPLQIPVSPSSSSTLL

SEQ ID NO: 252403 - protein, 14 aa, Homo sapiens
  Native (MAGC1_HUMAN)
QSTFEGFAQSSLQI

SEQ ID NO: 252404 - protein, 15 aa, Homo sapiens
  Native (MAGC1_HUMAN)
QSTFEGFAQSSLQIP

SEQ ID NO: 252405 - protein, 16 aa, Homo sapiens
  Native (MAGC1_HUMAN)
QSTFEGFAQSSLQIPV

SEQ ID NO: 252406 - protein, 17 aa, Homo sapiens
  Native (MAGC1_HUMAN)
QSTFEGFAQSSLQIPVS

SEQ ID NO: 252407 - protein, 18 aa, Homo sapiens
  Native (MAGC1_HUMAN)
QSTFEGFAQSSLQIPVSP

SEQ ID NO: 252408 - protein, 19 aa, Homo sapiens
  Native (MAGC1_HUMAN)
QSTFEGFAQSSLQIPVSPS

SEQ ID NO: 252409 - protein, 20 aa, Homo sapiens
  Native (MAGC1_HUMAN)
QSTFEGFAQSSLQIPVSPSF

SEQ ID NO: 252410 - protein, 21 aa, Homo sapiens
  Native (MAGC1_HUMAN)
QSTFEGFAQSSLQIPVSPSFS

SEQ ID NO: 252411 - protein, 22 aa, Homo sapiens
  Native (MAGC1_HUMAN)
QSTFEGFAQSSLQIPVSPSFSS

SEQ ID NO: 252412 - protein, 23 aa, Homo sapiens
  Native (MAGC1_HUMAN)
QSTFEGFAQSSLQIPVSPSFSST

SEQ ID NO: 252413 - protein, 24 aa, Homo sapiens
  Native (MAGC1_HUMAN)
QSTFEGFAQSSLQIPVSPSFSSTL

SEQ ID NO: 252414 - protein, 25 aa, Homo sapiens
  Native (MAGC1_HUMAN)
QSTFEGFAQSSLQIPVSPSFSSTLV

SEQ ID NO: 252415 - protein, 14 aa, Homo sapiens
  Native (MAGC1_HUMAN)
QSTFEGFPQSPLQI

SEQ ID NO: 252416 - protein, 15 aa, Homo sapiens
  Native (MAGC1_HUMAN)
QSTFEGFPQSPLQIP

SEQ ID NO: 252417 - protein, 16 aa, Homo sapiens
  Native (MAGC1_HUMAN)
QSTFEGFPQSPLQIPG

SEQ ID NO: 252418 - protein, 17 aa, Homo sapiens
  Native (MAGC1_HUMAN)
QSTFEGFPQSPLQIPGS

SEQ ID NO: 252419 - protein, 19 aa, Homo sapiens
  Native (MAGC1_HUMAN)
QSTFEGFPQSPLQIPGSPS

SEQ ID NO: 252420 - protein, 20 aa, Homo sapiens
  Native (MAGC1_HUMAN)
QSTFEGFPQSPLQIPGSPSF

SEQ ID NO: 252421 - protein, 21 aa, Homo sapiens
  Native (MAGC1_HUMAN)
QSTFEGFPQSPLQIPGSPSFS

SEQ ID NO: 252422 - protein, 22 aa, Homo sapiens
  Native (MAGC1_HUMAN)
QSTFEGFPQSPLQIPGSPSFSS

SEQ ID NO: 252423 - protein, 23 aa, Homo sapiens
  Native (MAGC1_HUMAN)
QSTFEGFPQSPLQIPGSPSFSST

SEQ ID NO: 252424 - protein, 24 aa, Homo sapiens
  Native (MAGC1_HUMAN)
QSTFEGFPQSPLQIPGSPSFSSTL

SEQ ID NO: 252425 - protein, 25 aa, Homo sapiens
  Native (MAGC1_HUMAN)
QSTFEGFPQSPLQIPGSPSFSSTLL

SEQ ID NO: 252426 - protein, 16 aa, Homo sapiens
  Native (MAGC1_HUMAN)
QSTFEGFPQSPLQIPQ

SEQ ID NO: 252427 - protein, 17 aa, Homo sapiens
  Native (MAGC1_HUMAN)
QSTFEGFPQSPLQIPQS

SEQ ID NO: 252428 - protein, 19 aa, Homo sapiens
  Native (MAGC1_HUMAN)
QSTFEGFPQSPLQIPQSPP

SEQ ID NO: 252429 - protein, 20 aa, Homo sapiens
  Native (MAGC1_HUMAN)
QSTFEGFPQSPLQIPQSPPE

SEQ ID NO: 252430 - protein, 21 aa, Homo sapiens
  Native (MAGC1_HUMAN)
QSTFEGFPQSPLQIPQSPPEG

SEQ ID NO: 252431 - protein, 22 aa, Homo sapiens
  Native (MAGC1_HUMAN)
QSTFEGFPQSPLQIPQSPPEGE

SEQ ID NO: 252432 - protein, 23 aa, Homo sapiens
  Native (MAGC1_HUMAN)
QSTFEGFPQSPLQIPQSPPEGEN

SEQ ID NO: 252433 - protein, 24 aa, Homo sapiens
  Native (MAGC1_HUMAN)
QSTFEGFPQSPLQIPQSPPEGENT

SEQ ID NO: 252434 - protein, 25 aa, Homo sapiens
  Native (MAGC1_HUMAN)
QSTFEGFPQSPLQIPQSPPEGENTH

SEQ ID NO: 252435 - protein, 16 aa, Homo sapiens
  Native (MAGC1_HUMAN)
QSTFEGFPQSPLQIPV

SEQ ID NO: 252436 - protein, 17 aa, Homo sapiens
  Native (MAGC1_HUMAN)
QSTFEGFPQSPLQIPVS

SEQ ID NO: 252437 - protein, 19 aa, Homo sapiens
  Native (MAGC1_HUMAN)
QSTFEGFPQSPLQIPVSSS

SEQ ID NO: 252438 - protein, 20 aa, Homo sapiens
  Native (MAGC1_HUMAN)
QSTFEGFPQSPLQIPVSSSS

SEQ ID NO: 252439 - protein, 21 aa, Homo sapiens
  Native (MAGC1_HUMAN)
QSTFEGFPQSPLQIPVSSSSS

SEQ ID NO: 252440 - protein, 22 aa, Homo sapiens
  Native (MAGC1_HUMAN)
QSTFEGFPQSPLQIPVSSSSSS

SEQ ID NO: 252441 - protein, 23 aa, Homo sapiens
  Native (MAGC1_HUMAN)
QSTFEGFPQSPLQIPVSSSSSST

SEQ ID NO: 252442 - protein, 24 aa, Homo sapiens
  Native (MAGC1_HUMAN)
QSTFEGFPQSPLQIPVSSSSSSTL

SEQ ID NO: 252443 - protein, 25 aa, Homo sapiens
  Native (MAGC1_HUMAN)
QSTFEGFPQSPLQIPVSSSSSSTLL

SEQ ID NO: 252444 - protein, 13 aa, Homo sapiens
  Native (MAGC1_HUMAN)
QSVLQIPVSAASS

SEQ ID NO: 252445 - protein, 14 aa, Homo sapiens
  Native (MAGC1_HUMAN)
QSVLQIPVSAASSS

SEQ ID NO: 252446 - protein, 15 aa, Homo sapiens
  Native (MAGC1_HUMAN)
QSVLQIPVSAASSST

SEQ ID NO: 252447 - protein, 16 aa, Homo sapiens
  Native (MAGC1_HUMAN)
QSVLQIPVSAASSSTL

SEQ ID NO: 252448 - protein, 17 aa, Homo sapiens
  Native (MAGC1_HUMAN)
QSVLQIPVSAASSSTLV

SEQ ID NO: 252449 - protein, 18 aa, Homo sapiens
  Native (MAGC1_HUMAN)
QSVLQIPVSAASSSTLVS

SEQ ID NO: 252450 - protein, 19 aa, Homo sapiens
  Native (MAGC1_HUMAN)
QSVLQIPVSAASSSTLVSI

SEQ ID NO: 252451 - protein, 20 aa, Homo sapiens
  Native (MAGC1_HUMAN)
QSVLQIPVSAASSSTLVSIF

SEQ ID NO: 252452 - protein, 21 aa, Homo sapiens
  Native (MAGC1_HUMAN)
QSVLQIPVSAASSSTLVSIFQ

SEQ ID NO: 252453 - protein, 22 aa, Homo sapiens
  Native (MAGC1_HUMAN)
QSVLQIPVSAASSSTLVSIFQS

SEQ ID NO: 252454 - protein, 23 aa, Homo sapiens
  Native (MAGC1_HUMAN)
QSVLQIPVSAASSSTLVSIFQSS

SEQ ID NO: 252455 - protein, 24 aa, Homo sapiens
  Native (MAGC1_HUMAN)
QSVLQIPVSAASSSTLVSIFQSSP

SEQ ID NO: 252456 - protein, 25 aa, Homo sapiens
  Native (MAGC1_HUMAN)
QSVLQIPVSAASSSTLVSIFQSSPE

SEQ ID NO: 252457 - protein, 15 aa, Homo sapiens
  Native (MAGC1_HUMAN)
QVKQPITKAEMLTNV

SEQ ID NO: 252458 - protein, 16 aa, Homo sapiens
  Native (MAGC1_HUMAN)
QVKQPITKAEMLTNVI

SEQ ID NO: 252459 - protein, 17 aa, Homo sapiens
  Native (MAGC1_HUMAN)
QVKQPITKAEMLTNVIS

SEQ ID NO: 252460 - protein, 18 aa, Homo sapiens
  Native (MAGC1_HUMAN)
QVKQPITKAEMLTNVISR

SEQ ID NO: 252461 - protein, 19 aa, Homo sapiens
  Native (MAGC1_HUMAN)
QVKQPITKAEMLTNVISRY

SEQ ID NO: 252462 - protein, 20 aa, Homo sapiens
  Native (MAGC1_HUMAN)
QVKQPITKAEMLTNVISRYT

SEQ ID NO: 252463 - protein, 21 aa, Homo sapiens
  Native (MAGC1_HUMAN)
QVKQPITKAEMLTNVISRYTG

SEQ ID NO: 252464 - protein, 22 aa, Homo sapiens
  Native (MAGC1_HUMAN)
QVKQPITKAEMLTNVISRYTGY

SEQ ID NO: 252465 - protein, 23 aa, Homo sapiens
  Native (MAGC1_HUMAN)
QVKQPITKAEMLTNVISRYTGYF

SEQ ID NO: 252466 - protein, 24 aa, Homo sapiens
  Native (MAGC1_HUMAN)
QVKQPITKAEMLTNVISRYTGYFP

SEQ ID NO: 252467 - protein, 25 aa, Homo sapiens
  Native (MAGC1_HUMAN)
QVKQPITKAEMLTNVISRYTGYFPV

SEQ ID NO: 252468 - protein, 15 aa, Homo sapiens
  Native (MAGC1_HUMAN)
RAGREHFAFGEPREL

SEQ ID NO: 252469 - protein, 16 aa, Homo sapiens
  Native (MAGC1_HUMAN)
RAGREHFAFGEPRELL

SEQ ID NO: 252470 - protein, 17 aa, Homo sapiens
  Native (MAGC1_HUMAN)
RAGREHFAFGEPRELLT

SEQ ID NO: 252471 - protein, 18 aa, Homo sapiens
  Native (MAGC1_HUMAN)
RAGREHFAFGEPRELLTK

SEQ ID NO: 252472 - protein, 19 aa, Homo sapiens
  Native (MAGC1_HUMAN)
RAGREHFAFGEPRELLTKV

SEQ ID NO: 252473 - protein, 20 aa, Homo sapiens
  Native (MAGC1_HUMAN)
RAGREHFAFGEPRELLTKVW

SEQ ID NO: 252474 - protein, 21 aa, Homo sapiens
  Native (MAGC1_HUMAN)
RAGREHFAFGEPRELLTKVWV

SEQ ID NO: 252475 - protein, 22 aa, Homo sapiens
  Native (MAGC1_HUMAN)
RAGREHFAFGEPRELLTKVWVQ

SEQ ID NO: 252476 - protein, 23 aa, Homo sapiens
  Native (MAGC1_HUMAN)
RAGREHFAFGEPRELLTKVWVQE

SEQ ID NO: 252477 - protein, 24 aa, Homo sapiens
  Native (MAGC1_HUMAN)
RAGREHFAFGEPRELLTKVWVQEH

SEQ ID NO: 252478 - protein, 25 aa, Homo sapiens
  Native (MAGC1_HUMAN)
RAGREHFAFGEPRELLTKVWVQEHY

SEQ ID NO: 252479 - protein, 15 aa, Homo sapiens
  Native (MAGC1_HUMAN)
RAHSEVIKRKVVEFL

SEQ ID NO: 252480 - protein, 16 aa, Homo sapiens
  Native (MAGC1_HUMAN)
RAHSEVIKRKVVEFLA

SEQ ID NO: 252481 - protein, 17 aa, Homo sapiens
  Native (MAGC1_HUMAN)
RAHSEVIKRKVVEFLAM

SEQ ID NO: 252482 - protein, 18 aa, Homo sapiens
  Native (MAGC1_HUMAN)
RAHSEVIKRKVVEFLAML

SEQ ID NO: 252483 - protein, 19 aa, Homo sapiens
  Native (MAGC1_HUMAN)
RAHSEVIKRKVVEFLAMLK

SEQ ID NO: 252484 - protein, 20 aa, Homo sapiens
  Native (MAGC1_HUMAN)
RAHSEVIKRKVVEFLAMLKN

SEQ ID NO: 252485 - protein, 21 aa, Homo sapiens
  Native (MAGC1_HUMAN)
RAHSEVIKRKVVEFLAMLKNT

SEQ ID NO: 252486 - protein, 22 aa, Homo sapiens
  Native (MAGC1_HUMAN)
RAHSEVIKRKVVEFLAMLKNTV

SEQ ID NO: 252487 - protein, 23 aa, Homo sapiens
  Native (MAGC1_HUMAN)
RAHSEVIKRKVVEFLAMLKNTVP

SEQ ID NO: 252488 - protein, 24 aa, Homo sapiens
  Native (MAGC1_HUMAN)
RAHSEVIKRKVVEFLAMLKNTVPI

SEQ ID NO: 252489 - protein, 25 aa, Homo sapiens
  Native (MAGC1_HUMAN)
RAHSEVIKRKVVEFLAMLKNTVPIT

SEQ ID NO: 252490 - protein, 22 aa, Homo sapiens
  Native (MAGC1_HUMAN)
RAQAIIDTTDDSTATESASSSV

SEQ ID NO: 252491 - protein, 23 aa, Homo sapiens
  Native (MAGC1_HUMAN)
RAQAIIDTTDDSTATESASSSVM

SEQ ID NO: 252492 - protein, 24 aa, Homo sapiens
  Native (MAGC1_HUMAN)
RAQAIIDTTDDSTATESASSSVMS

SEQ ID NO: 252493 - protein, 25 aa, Homo sapiens
  Native (MAGC1_HUMAN)
RAQAIIDTTDDSTATESASSSVMSP

SEQ ID NO: 252494 - protein, 13 aa, Homo sapiens
  Native (MAGC1_HUMAN)
REFIEILFGISLR

SEQ ID NO: 252495 - protein, 14 aa, Homo sapiens
  Native (MAGC1_HUMAN)
REFIEILFGISLRE

SEQ ID NO: 252496 - protein, 15 aa, Homo sapiens
  Native (MAGC1_HUMAN)
REFIEILFGISLREV

SEQ ID NO: 252497 - protein, 16 aa, Homo sapiens
  Native (MAGC1_HUMAN)
REFIEILFGISLREVD

SEQ ID NO: 252498 - protein, 17 aa, Homo sapiens
  Native (MAGC1_HUMAN)
REFIEILFGISLREVDP

SEQ ID NO: 252499 - protein, 18 aa, Homo sapiens
  Native (MAGC1_HUMAN)
REFIEILFGISLREVDPD

SEQ ID NO: 252500 - protein, 19 aa, Homo sapiens
  Native (MAGC1_HUMAN)
REFIEILFGISLREVDPDD

SEQ ID NO: 252501 - protein, 20 aa, Homo sapiens
  Native (MAGC1_HUMAN)
REFIEILFGISLREVDPDDS

SEQ ID NO: 252502 - protein, 21 aa, Homo sapiens
  Native (MAGC1_HUMAN)
REFIEILFGISLREVDPDDSY

SEQ ID NO: 252503 - protein, 22 aa, Homo sapiens
  Native (MAGC1_HUMAN)
REFIEILFGISLREVDPDDSYV

SEQ ID NO: 252504 - protein, 23 aa, Homo sapiens
  Native (MAGC1_HUMAN)
REFIEILFGISLREVDPDDSYVF

SEQ ID NO: 252505 - protein, 24 aa, Homo sapiens
  Native (MAGC1_HUMAN)
REFIEILFGISLREVDPDDSYVFV

SEQ ID NO: 252506 - protein, 25 aa, Homo sapiens
  Native (MAGC1_HUMAN)
REFIEILFGISLREVDPDDSYVFVN

SEQ ID NO: 252507 - protein, 13 aa, Homo sapiens
  Native (MAGC1_HUMAN)
REHFAFGEPRELL

SEQ ID NO: 252508 - protein, 14 aa, Homo sapiens
  Native (MAGC1_HUMAN)
REHFAFGEPRELLT

SEQ ID NO: 252509 - protein, 15 aa, Homo sapiens
  Native (MAGC1_HUMAN)
REHFAFGEPRELLTK

SEQ ID NO: 252510 - protein, 16 aa, Homo sapiens
  Native (MAGC1_HUMAN)
REHFAFGEPRELLTKV

SEQ ID NO: 252511 - protein, 17 aa, Homo sapiens
  Native (MAGC1_HUMAN)
REHFAFGEPRELLTKVW

SEQ ID NO: 252512 - protein, 18 aa, Homo sapiens
  Native (MAGC1_HUMAN)
REHFAFGEPRELLTKVWV

SEQ ID NO: 252513 - protein, 19 aa, Homo sapiens
  Native (MAGC1_HUMAN)
REHFAFGEPRELLTKVWVQ

SEQ ID NO: 252514 - protein, 20 aa, Homo sapiens
  Native (MAGC1_HUMAN)
REHFAFGEPRELLTKVWVQE

SEQ ID NO: 252515 - protein, 21 aa, Homo sapiens
  Native (MAGC1_HUMAN)
REHFAFGEPRELLTKVWVQEH

SEQ ID NO: 252516 - protein, 22 aa, Homo sapiens
  Native (MAGC1_HUMAN)
REHFAFGEPRELLTKVWVQEHY

SEQ ID NO: 252517 - protein, 23 aa, Homo sapiens
  Native (MAGC1_HUMAN)
REHFAFGEPRELLTKVWVQEHYL

SEQ ID NO: 252518 - protein, 24 aa, Homo sapiens
  Native (MAGC1_HUMAN)
REHFAFGEPRELLTKVWVQEHYLE

SEQ ID NO: 252519 - protein, 25 aa, Homo sapiens
  Native (MAGC1_HUMAN)
REHFAFGEPRELLTKVWVQEHYLEY

SEQ ID NO: 252520 - protein, 13 aa, Homo sapiens
  Native (MAGC1_HUMAN)
RELLTKVWVQEHY

SEQ ID NO: 252521 - protein, 14 aa, Homo sapiens
  Native (MAGC1_HUMAN)
RELLTKVWVQEHYL

SEQ ID NO: 252522 - protein, 15 aa, Homo sapiens
  Native (MAGC1_HUMAN)
RELLTKVWVQEHYLE

SEQ ID NO: 252523 - protein, 16 aa, Homo sapiens
  Native (MAGC1_HUMAN)
RELLTKVWVQEHYLEY

SEQ ID NO: 252524 - protein, 17 aa, Homo sapiens
  Native (MAGC1_HUMAN)
RELLTKVWVQEHYLEYR

SEQ ID NO: 252525 - protein, 18 aa, Homo sapiens
  Native (MAGC1_HUMAN)
RELLTKVWVQEHYLEYRE

SEQ ID NO: 252526 - protein, 19 aa, Homo sapiens
  Native (MAGC1_HUMAN)
RELLTKVWVQEHYLEYREV

SEQ ID NO: 252527 - protein, 20 aa, Homo sapiens
  Native (MAGC1_HUMAN)
RELLTKVWVQEHYLEYREVP

SEQ ID NO: 252528 - protein, 21 aa, Homo sapiens
  Native (MAGC1_HUMAN)
RELLTKVWVQEHYLEYREVPN

SEQ ID NO: 252529 - protein, 22 aa, Homo sapiens
  Native (MAGC1_HUMAN)
RELLTKVWVQEHYLEYREVPNS

SEQ ID NO: 252530 - protein, 23 aa, Homo sapiens
  Native (MAGC1_HUMAN)
RELLTKVWVQEHYLEYREVPNSS

SEQ ID NO: 252531 - protein, 24 aa, Homo sapiens
  Native (MAGC1_HUMAN)
RELLTKVWVQEHYLEYREVPNSSP

SEQ ID NO: 252532 - protein, 25 aa, Homo sapiens
  Native (MAGC1_HUMAN)
RELLTKVWVQEHYLEYREVPNSSPP

SEQ ID NO: 252533 - protein, 17 aa, Homo sapiens
  Native (MAGC1_HUMAN)
REVDPDDSYVFVNTLDL

SEQ ID NO: 252534 - protein, 18 aa, Homo sapiens
  Native (MAGC1_HUMAN)
REVDPDDSYVFVNTLDLT

SEQ ID NO: 252535 - protein, 19 aa, Homo sapiens
  Native (MAGC1_HUMAN)
REVDPDDSYVFVNTLDLTS

SEQ ID NO: 252536 - protein, 20 aa, Homo sapiens
  Native (MAGC1_HUMAN)
REVDPDDSYVFVNTLDLTSE

SEQ ID NO: 252537 - protein, 21 aa, Homo sapiens
  Native (MAGC1_HUMAN)
REVDPDDSYVFVNTLDLTSEG

SEQ ID NO: 252538 - protein, 22 aa, Homo sapiens
  Native (MAGC1_HUMAN)
REVDPDDSYVFVNTLDLTSEGC

SEQ ID NO: 252539 - protein, 23 aa, Homo sapiens
  Native (MAGC1_HUMAN)
REVDPDDSYVFVNTLDLTSEGCL

SEQ ID NO: 252540 - protein, 24 aa, Homo sapiens
  Native (MAGC1_HUMAN)
REVDPDDSYVFVNTLDLTSEGCLS

SEQ ID NO: 252541 - protein, 25 aa, Homo sapiens
  Native (MAGC1_HUMAN)
REVDPDDSYVFVNTLDLTSEGCLSD

SEQ ID NO: 252542 - protein, 19 aa, Homo sapiens
  Native (MAGC1_HUMAN)
REVPNSSPPRYEFLWGPRA

SEQ ID NO: 252543 - protein, 20 aa, Homo sapiens
  Native (MAGC1_HUMAN)
REVPNSSPPRYEFLWGPRAH

SEQ ID NO: 252544 - protein, 21 aa, Homo sapiens
  Native (MAGC1_HUMAN)
REVPNSSPPRYEFLWGPRAHS

SEQ ID NO: 252545 - protein, 22 aa, Homo sapiens
  Native (MAGC1_HUMAN)
REVPNSSPPRYEFLWGPRAHSE

SEQ ID NO: 252546 - protein, 23 aa, Homo sapiens
  Native (MAGC1_HUMAN)
REVPNSSPPRYEFLWGPRAHSEV

SEQ ID NO: 252547 - protein, 24 aa, Homo sapiens
  Native (MAGC1_HUMAN)
REVPNSSPPRYEFLWGPRAHSEVI

SEQ ID NO: 252548 - protein, 25 aa, Homo sapiens
  Native (MAGC1_HUMAN)
REVPNSSPPRYEFLWGPRAHSEVIK

SEQ ID NO: 252549 - protein, 13 aa, Homo sapiens
  Native (MAGC1_HUMAN)
RFLLLKYQVKQPI

SEQ ID NO: 252550 - protein, 14 aa, Homo sapiens
  Native (MAGC1_HUMAN)
RFLLLKYQVKQPIT

SEQ ID NO: 252551 - protein, 15 aa, Homo sapiens
  Native (MAGC1_HUMAN)
RFLLLKYQVKQPITK

SEQ ID NO: 252552 - protein, 16 aa, Homo sapiens
  Native (MAGC1_HUMAN)
RFLLLKYQVKQPITKA

SEQ ID NO: 252553 - protein, 17 aa, Homo sapiens
  Native (MAGC1_HUMAN)
RFLLLKYQVKQPITKAE

SEQ ID NO: 252554 - protein, 18 aa, Homo sapiens
  Native (MAGC1_HUMAN)
RFLLLKYQVKQPITKAEM

SEQ ID NO: 252555 - protein, 19 aa, Homo sapiens
  Native (MAGC1_HUMAN)
RFLLLKYQVKQPITKAEML

SEQ ID NO: 252556 - protein, 20 aa, Homo sapiens
  Native (MAGC1_HUMAN)
RFLLLKYQVKQPITKAEMLT

SEQ ID NO: 252557 - protein, 21 aa, Homo sapiens
  Native (MAGC1_HUMAN)
RFLLLKYQVKQPITKAEMLTN

SEQ ID NO: 252558 - protein, 22 aa, Homo sapiens
  Native (MAGC1_HUMAN)
RFLLLKYQVKQPITKAEMLTNV

SEQ ID NO: 252559 - protein, 23 aa, Homo sapiens
  Native (MAGC1_HUMAN)
RFLLLKYQVKQPITKAEMLTNVI

SEQ ID NO: 252560 - protein, 24 aa, Homo sapiens
  Native (MAGC1_HUMAN)
RFLLLKYQVKQPITKAEMLTNVIS

SEQ ID NO: 252561 - protein, 25 aa, Homo sapiens
  Native (MAGC1_HUMAN)
RFLLLKYQVKQPITKAEMLTNVISR

SEQ ID NO: 252562 - protein, 13 aa, Homo sapiens
  Native (MAGC1_HUMAN)
RKAREFIEILFGI

SEQ ID NO: 252563 - protein, 14 aa, Homo sapiens
  Native (MAGC1_HUMAN)
RKAREFIEILFGIS

SEQ ID NO: 252564 - protein, 15 aa, Homo sapiens
  Native (MAGC1_HUMAN)
RKAREFIEILFGISL

SEQ ID NO: 252565 - protein, 16 aa, Homo sapiens
  Native (MAGC1_HUMAN)
RKAREFIEILFGISLR

SEQ ID NO: 252566 - protein, 17 aa, Homo sapiens
  Native (MAGC1_HUMAN)
RKAREFIEILFGISLRE

SEQ ID NO: 252567 - protein, 18 aa, Homo sapiens
  Native (MAGC1_HUMAN)
RKAREFIEILFGISLREV

SEQ ID NO: 252568 - protein, 19 aa, Homo sapiens
  Native (MAGC1_HUMAN)
RKAREFIEILFGISLREVD

SEQ ID NO: 252569 - protein, 20 aa, Homo sapiens
  Native (MAGC1_HUMAN)
RKAREFIEILFGISLREVDP

SEQ ID NO: 252570 - protein, 21 aa, Homo sapiens
  Native (MAGC1_HUMAN)
RKAREFIEILFGISLREVDPD

SEQ ID NO: 252571 - protein, 22 aa, Homo sapiens
  Native (MAGC1_HUMAN)
RKAREFIEILFGISLREVDPDD

SEQ ID NO: 252572 - protein, 24 aa, Homo sapiens
  Native (MAGC1_HUMAN)
RKAREFIEILFGISLREVDPDDSY

SEQ ID NO: 252573 - protein, 25 aa, Homo sapiens
  Native (MAGC1_HUMAN)
RKAREFIEILFGISLREVDPDDSYV

SEQ ID NO: 252574 - protein, 13 aa, Homo sapiens
  Native (MAGC1_HUMAN)
RKVVEFLAMLKNT

SEQ ID NO: 252575 - protein, 14 aa, Homo sapiens
  Native (MAGC1_HUMAN)
RKVVEFLAMLKNTV

SEQ ID NO: 252576 - protein, 15 aa, Homo sapiens
  Native (MAGC1_HUMAN)
RKVVEFLAMLKNTVP

SEQ ID NO: 252577 - protein, 16 aa, Homo sapiens
  Native (MAGC1_HUMAN)
RKVVEFLAMLKNTVPI

SEQ ID NO: 252578 - protein, 17 aa, Homo sapiens
  Native (MAGC1_HUMAN)
RKVVEFLAMLKNTVPIT

SEQ ID NO: 252579 - protein, 18 aa, Homo sapiens
  Native (MAGC1_HUMAN)
RKVVEFLAMLKNTVPITF

SEQ ID NO: 252580 - protein, 19 aa, Homo sapiens
  Native (MAGC1_HUMAN)
RKVVEFLAMLKNTVPITFP

SEQ ID NO: 252581 - protein, 20 aa, Homo sapiens
  Native (MAGC1_HUMAN)
RKVVEFLAMLKNTVPITFPS

SEQ ID NO: 252582 - protein, 21 aa, Homo sapiens
  Native (MAGC1_HUMAN)
RKVVEFLAMLKNTVPITFPSS

SEQ ID NO: 252583 - protein, 22 aa, Homo sapiens
  Native (MAGC1_HUMAN)
RKVVEFLAMLKNTVPITFPSSY

SEQ ID NO: 252584 - protein, 23 aa, Homo sapiens
  Native (MAGC1_HUMAN)
RKVVEFLAMLKNTVPITFPSSYK

SEQ ID NO: 252585 - protein, 24 aa, Homo sapiens
  Native (MAGC1_HUMAN)
RKVVEFLAMLKNTVPITFPSSYKD

SEQ ID NO: 252586 - protein, 25 aa, Homo sapiens
  Native (MAGC1_HUMAN)
RKVVEFLAMLKNTVPITFPSSYKDA

SEQ ID NO: 252587 - protein, 15 aa, Homo sapiens
  Native (MAGC1_HUMAN)
RLLILILSIIFIKGT

SEQ ID NO: 252588 - protein, 16 aa, Homo sapiens
  Native (MAGC1_HUMAN)
RLLILILSIIFIKGTY

SEQ ID NO: 252589 - protein, 17 aa, Homo sapiens
  Native (MAGC1_HUMAN)
RLLILILSIIFIKGTYA

SEQ ID NO: 252590 - protein, 18 aa, Homo sapiens
  Native (MAGC1_HUMAN)
RLLILILSIIFIKGTYAS

SEQ ID NO: 252591 - protein, 19 aa, Homo sapiens
  Native (MAGC1_HUMAN)
RLLILILSIIFIKGTYASE

SEQ ID NO: 252592 - protein, 20 aa, Homo sapiens
  Native (MAGC1_HUMAN)
RLLILILSIIFIKGTYASEE

SEQ ID NO: 252593 - protein, 21 aa, Homo sapiens
  Native (MAGC1_HUMAN)
RLLILILSIIFIKGTYASEEV

SEQ ID NO: 252594 - protein, 22 aa, Homo sapiens
  Native (MAGC1_HUMAN)
RLLILILSIIFIKGTYASEEVI

SEQ ID NO: 252595 - protein, 23 aa, Homo sapiens
  Native (MAGC1_HUMAN)
RLLILILSIIFIKGTYASEEVIW

SEQ ID NO: 252596 - protein, 24 aa, Homo sapiens
  Native (MAGC1_HUMAN)
RLLILILSIIFIKGTYASEEVIWD

SEQ ID NO: 252597 - protein, 25 aa, Homo sapiens
  Native (MAGC1_HUMAN)
RLLILILSIIFIKGTYASEEVIWDV

SEQ ID NO: 252598 - protein, 13 aa, Homo sapiens
  Native (MAGC1_HUMAN)
RPVSSFFSYTLAS

SEQ ID NO: 252599 - protein, 14 aa, Homo sapiens
  Native (MAGC1_HUMAN)
RPVSSFFSYTLASL

SEQ ID NO: 252600 - protein, 15 aa, Homo sapiens
  Native (MAGC1_HUMAN)
RPVSSFFSYTLASLL

SEQ ID NO: 252601 - protein, 16 aa, Homo sapiens
  Native (MAGC1_HUMAN)
RPVSSFFSYTLASLLQ

SEQ ID NO: 252602 - protein, 18 aa, Homo sapiens
  Native (MAGC1_HUMAN)
RPVSSFFSYTLASLLQSS

SEQ ID NO: 252603 - protein, 19 aa, Homo sapiens
  Native (MAGC1_HUMAN)
RPVSSFFSYTLASLLQSSH

SEQ ID NO: 252604 - protein, 20 aa, Homo sapiens
  Native (MAGC1_HUMAN)
RPVSSFFSYTLASLLQSSHE

SEQ ID NO: 252605 - protein, 21 aa, Homo sapiens
  Native (MAGC1_HUMAN)
RPVSSFFSYTLASLLQSSHES

SEQ ID NO: 252606 - protein, 22 aa, Homo sapiens
  Native (MAGC1_HUMAN)
RPVSSFFSYTLASLLQSSHESP

SEQ ID NO: 252607 - protein, 23 aa, Homo sapiens
  Native (MAGC1_HUMAN)
RPVSSFFSYTLASLLQSSHESPQ

SEQ ID NO: 252608 - protein, 24 aa, Homo sapiens
  Native (MAGC1_HUMAN)
RPVSSFFSYTLASLLQSSHESPQS

SEQ ID NO: 252609 - protein, 25 aa, Homo sapiens
  Native (MAGC1_HUMAN)
RPVSSFFSYTLASLLQSSHESPQSP

SEQ ID NO: 252610 - protein, 13 aa, Homo sapiens
  Native (MAGC1_HUMAN)
RSFSSTLLSIFQS

SEQ ID NO: 252611 - protein, 14 aa, Homo sapiens
  Native (MAGC1_HUMAN)
RSFSSTLLSIFQSS

SEQ ID NO: 252612 - protein, 15 aa, Homo sapiens
  Native (MAGC1_HUMAN)
RSFSSTLLSIFQSSP

SEQ ID NO: 252613 - protein, 16 aa, Homo sapiens
  Native (MAGC1_HUMAN)
RSFSSTLLSIFQSSPE

SEQ ID NO: 252614 - protein, 17 aa, Homo sapiens
  Native (MAGC1_HUMAN)
RSFSSTLLSIFQSSPER

SEQ ID NO: 252615 - protein, 18 aa, Homo sapiens
  Native (MAGC1_HUMAN)
RSFSSTLLSIFQSSPERT

SEQ ID NO: 252616 - protein, 19 aa, Homo sapiens
  Native (MAGC1_HUMAN)
RSFSSTLLSIFQSSPERTQ

SEQ ID NO: 252617 - protein, 20 aa, Homo sapiens
  Native (MAGC1_HUMAN)
RSFSSTLLSIFQSSPERTQS

SEQ ID NO: 252618 - protein, 21 aa, Homo sapiens
  Native (MAGC1_HUMAN)
RSFSSTLLSIFQSSPERTQST

SEQ ID NO: 252619 - protein, 22 aa, Homo sapiens
  Native (MAGC1_HUMAN)
RSFSSTLLSIFQSSPERTQSTF

SEQ ID NO: 252620 - protein, 23 aa, Homo sapiens
  Native (MAGC1_HUMAN)
RSFSSTLLSIFQSSPERTQSTFE

SEQ ID NO: 252621 - protein, 24 aa, Homo sapiens
  Native (MAGC1_HUMAN)
RSFSSTLLSIFQSSPERTQSTFEG

SEQ ID NO: 252622 - protein, 25 aa, Homo sapiens
  Native (MAGC1_HUMAN)
RSFSSTLLSIFQSSPERTQSTFEGF

SEQ ID NO: 252623 - protein, 14 aa, Homo sapiens
  Native (MAGC1_HUMAN)
RTHSTFEGFPQSLL

SEQ ID NO: 252624 - protein, 15 aa, Homo sapiens
  Native (MAGC1_HUMAN)
RTHSTFEGFPQSLLQ

SEQ ID NO: 252625 - protein, 16 aa, Homo sapiens
  Native (MAGC1_HUMAN)
RTHSTFEGFPQSLLQI

SEQ ID NO: 252626 - protein, 17 aa, Homo sapiens
  Native (MAGC1_HUMAN)
RTHSTFEGFPQSLLQIP

SEQ ID NO: 252627 - protein, 18 aa, Homo sapiens
  Native (MAGC1_HUMAN)
RTHSTFEGFPQSLLQIPM

SEQ ID NO: 252628 - protein, 19 aa, Homo sapiens
  Native (MAGC1_HUMAN)
RTHSTFEGFPQSLLQIPMT

SEQ ID NO: 252629 - protein, 20 aa, Homo sapiens
  Native (MAGC1_HUMAN)
RTHSTFEGFPQSLLQIPMTS

SEQ ID NO: 252630 - protein, 21 aa, Homo sapiens
  Native (MAGC1_HUMAN)
RTHSTFEGFPQSLLQIPMTSS

SEQ ID NO: 252631 - protein, 22 aa, Homo sapiens
  Native (MAGC1_HUMAN)
RTHSTFEGFPQSLLQIPMTSSF

SEQ ID NO: 252632 - protein, 23 aa, Homo sapiens
  Native (MAGC1_HUMAN)
RTHSTFEGFPQSLLQIPMTSSFS

SEQ ID NO: 252633 - protein, 24 aa, Homo sapiens
  Native (MAGC1_HUMAN)
RTHSTFEGFPQSLLQIPMTSSFSS

SEQ ID NO: 252634 - protein, 25 aa, Homo sapiens
  Native (MAGC1_HUMAN)
RTHSTFEGFPQSLLQIPMTSSFSST

SEQ ID NO: 252635 - protein, 15 aa, Homo sapiens
  Native (MAGC1_HUMAN)
RTHSTFEGFPQSPLQ

SEQ ID NO: 252636 - protein, 16 aa, Homo sapiens
  Native (MAGC1_HUMAN)
RTHSTFEGFPQSPLQI

SEQ ID NO: 252637 - protein, 17 aa, Homo sapiens
  Native (MAGC1_HUMAN)
RTHSTFEGFPQSPLQIP

SEQ ID NO: 252638 - protein, 19 aa, Homo sapiens
  Native (MAGC1_HUMAN)
RTHSTFEGFPQSPLQIPMT

SEQ ID NO: 252639 - protein, 20 aa, Homo sapiens
  Native (MAGC1_HUMAN)
RTHSTFEGFPQSPLQIPMTS

SEQ ID NO: 252640 - protein, 21 aa, Homo sapiens
  Native (MAGC1_HUMAN)
RTHSTFEGFPQSPLQIPMTSS

SEQ ID NO: 252641 - protein, 22 aa, Homo sapiens
  Native (MAGC1_HUMAN)
RTHSTFEGFPQSPLQIPMTSSF

SEQ ID NO: 252642 - protein, 23 aa, Homo sapiens
  Native (MAGC1_HUMAN)
RTHSTFEGFPQSPLQIPMTSSFS

SEQ ID NO: 252643 - protein, 24 aa, Homo sapiens
  Native (MAGC1_HUMAN)
RTHSTFEGFPQSPLQIPMTSSFSS

SEQ ID NO: 252644 - protein, 25 aa, Homo sapiens
  Native (MAGC1_HUMAN)
RTHSTFEGFPQSPLQIPMTSSFSST

SEQ ID NO: 252645 - protein, 19 aa, Homo sapiens
  Native (MAGC1_HUMAN)
RTHSTFEGFPQSPLQIPVS

SEQ ID NO: 252646 - protein, 20 aa, Homo sapiens
  Native (MAGC1_HUMAN)
RTHSTFEGFPQSPLQIPVSS

SEQ ID NO: 252647 - protein, 21 aa, Homo sapiens
  Native (MAGC1_HUMAN)
RTHSTFEGFPQSPLQIPVSSS

SEQ ID NO: 252648 - protein, 22 aa, Homo sapiens
  Native (MAGC1_HUMAN)
RTHSTFEGFPQSPLQIPVSSSS

SEQ ID NO: 252649 - protein, 23 aa, Homo sapiens
  Native (MAGC1_HUMAN)
RTHSTFEGFPQSPLQIPVSSSSS

SEQ ID NO: 252650 - protein, 24 aa, Homo sapiens
  Native (MAGC1_HUMAN)
RTHSTFEGFPQSPLQIPVSSSSSS

SEQ ID NO: 252651 - protein, 25 aa, Homo sapiens
  Native (MAGC1_HUMAN)
RTHSTFEGFPQSPLQIPVSSSSSSS

SEQ ID NO: 252652 - protein, 14 aa, Homo sapiens
  Native (MAGC1_HUMAN)
RTQSTFEGFAQSPL

SEQ ID NO: 252653 - protein, 15 aa, Homo sapiens
  Native (MAGC1_HUMAN)
RTQSTFEGFAQSPLQ

SEQ ID NO: 252654 - protein, 16 aa, Homo sapiens
  Native (MAGC1_HUMAN)
RTQSTFEGFAQSPLQI

SEQ ID NO: 252655 - protein, 17 aa, Homo sapiens
  Native (MAGC1_HUMAN)
RTQSTFEGFAQSPLQIP

SEQ ID NO: 252656 - protein, 18 aa, Homo sapiens
  Native (MAGC1_HUMAN)
RTQSTFEGFAQSPLQIPV

SEQ ID NO: 252657 - protein, 19 aa, Homo sapiens
  Native (MAGC1_HUMAN)
RTQSTFEGFAQSPLQIPVS

SEQ ID NO: 252658 - protein, 20 aa, Homo sapiens
  Native (MAGC1_HUMAN)
RTQSTFEGFAQSPLQIPVSP

SEQ ID NO: 252659 - protein, 21 aa, Homo sapiens
  Native (MAGC1_HUMAN)
RTQSTFEGFAQSPLQIPVSPS

SEQ ID NO: 252660 - protein, 22 aa, Homo sapiens
  Native (MAGC1_HUMAN)
RTQSTFEGFAQSPLQIPVSPSS

SEQ ID NO: 252661 - protein, 23 aa, Homo sapiens
  Native (MAGC1_HUMAN)
RTQSTFEGFAQSPLQIPVSPSSS

SEQ ID NO: 252662 - protein, 24 aa, Homo sapiens
  Native (MAGC1_HUMAN)
RTQSTFEGFAQSPLQIPVSPSSSS

SEQ ID NO: 252663 - protein, 25 aa, Homo sapiens
  Native (MAGC1_HUMAN)
RTQSTFEGFAQSPLQIPVSPSSSST

SEQ ID NO: 252664 - protein, 14 aa, Homo sapiens
  Native (MAGC1_HUMAN)
RTQSTFEGFAQSSL

SEQ ID NO: 252665 - protein, 15 aa, Homo sapiens
  Native (MAGC1_HUMAN)
RTQSTFEGFAQSSLQ

SEQ ID NO: 252666 - protein, 16 aa, Homo sapiens
  Native (MAGC1_HUMAN)
RTQSTFEGFAQSSLQI

SEQ ID NO: 252667 - protein, 17 aa, Homo sapiens
  Native (MAGC1_HUMAN)
RTQSTFEGFAQSSLQIP

SEQ ID NO: 252668 - protein, 18 aa, Homo sapiens
  Native (MAGC1_HUMAN)
RTQSTFEGFAQSSLQIPV

SEQ ID NO: 252669 - protein, 19 aa, Homo sapiens
  Native (MAGC1_HUMAN)
RTQSTFEGFAQSSLQIPVS

SEQ ID NO: 252670 - protein, 20 aa, Homo sapiens
  Native (MAGC1_HUMAN)
RTQSTFEGFAQSSLQIPVSP

SEQ ID NO: 252671 - protein, 21 aa, Homo sapiens
  Native (MAGC1_HUMAN)
RTQSTFEGFAQSSLQIPVSPS

SEQ ID NO: 252672 - protein, 22 aa, Homo sapiens
  Native (MAGC1_HUMAN)
RTQSTFEGFAQSSLQIPVSPSF

SEQ ID NO: 252673 - protein, 23 aa, Homo sapiens
  Native (MAGC1_HUMAN)
RTQSTFEGFAQSSLQIPVSPSFS

SEQ ID NO: 252674 - protein, 24 aa, Homo sapiens
  Native (MAGC1_HUMAN)
RTQSTFEGFAQSSLQIPVSPSFSS

SEQ ID NO: 252675 - protein, 25 aa, Homo sapiens
  Native (MAGC1_HUMAN)
RTQSTFEGFAQSSLQIPVSPSFSST

SEQ ID NO: 252676 - protein, 14 aa, Homo sapiens
  Native (MAGC1_HUMAN)
RTQSTFEGFPQSPL

SEQ ID NO: 252677 - protein, 15 aa, Homo sapiens
  Native (MAGC1_HUMAN)
RTQSTFEGFPQSPLQ

SEQ ID NO: 252678 - protein, 16 aa, Homo sapiens
  Native (MAGC1_HUMAN)
RTQSTFEGFPQSPLQI

SEQ ID NO: 252679 - protein, 17 aa, Homo sapiens
  Native (MAGC1_HUMAN)
RTQSTFEGFPQSPLQIP

SEQ ID NO: 252680 - protein, 18 aa, Homo sapiens
  Native (MAGC1_HUMAN)
RTQSTFEGFPQSPLQIPV

SEQ ID NO: 252681 - protein, 19 aa, Homo sapiens
  Native (MAGC1_HUMAN)
RTQSTFEGFPQSPLQIPVS

SEQ ID NO: 252682 - protein, 20 aa, Homo sapiens
  Native (MAGC1_HUMAN)
RTQSTFEGFPQSPLQIPVSS

SEQ ID NO: 252683 - protein, 21 aa, Homo sapiens
  Native (MAGC1_HUMAN)
RTQSTFEGFPQSPLQIPVSSS

SEQ ID NO: 252684 - protein, 22 aa, Homo sapiens
  Native (MAGC1_HUMAN)
RTQSTFEGFPQSPLQIPVSSSS

SEQ ID NO: 252685 - protein, 23 aa, Homo sapiens
  Native (MAGC1_HUMAN)
RTQSTFEGFPQSPLQIPVSSSSS

SEQ ID NO: 252686 - protein, 24 aa, Homo sapiens
  Native (MAGC1_HUMAN)
RTQSTFEGFPQSPLQIPVSSSSSS

SEQ ID NO: 252687 - protein, 25 aa, Homo sapiens
  Native (MAGC1_HUMAN)
RTQSTFEGFPQSPLQIPVSSSSSST

SEQ ID NO: 252688 - protein, 13 aa, Homo sapiens
  Native (MAGC1_HUMAN)
RYEFLWGPRAHSE

SEQ ID NO: 252689 - protein, 14 aa, Homo sapiens
  Native (MAGC1_HUMAN)
RYEFLWGPRAHSEV

SEQ ID NO: 252690 - protein, 16 aa, Homo sapiens
  Native (MAGC1_HUMAN)
RYEFLWGPRAHSEVIK

SEQ ID NO: 252691 - protein, 17 aa, Homo sapiens
  Native (MAGC1_HUMAN)
RYEFLWGPRAHSEVIKR

SEQ ID NO: 252692 - protein, 18 aa, Homo sapiens
  Native (MAGC1_HUMAN)
RYEFLWGPRAHSEVIKRK

SEQ ID NO: 252693 - protein, 19 aa, Homo sapiens
  Native (MAGC1_HUMAN)
RYEFLWGPRAHSEVIKRKV

SEQ ID NO: 252694 - protein, 20 aa, Homo sapiens
  Native (MAGC1_HUMAN)
RYEFLWGPRAHSEVIKRKVV

SEQ ID NO: 252695 - protein, 21 aa, Homo sapiens
  Native (MAGC1_HUMAN)
RYEFLWGPRAHSEVIKRKVVE

SEQ ID NO: 252696 - protein, 22 aa, Homo sapiens
  Native (MAGC1_HUMAN)
RYEFLWGPRAHSEVIKRKVVEF

SEQ ID NO: 252697 - protein, 23 aa, Homo sapiens
  Native (MAGC1_HUMAN)
RYEFLWGPRAHSEVIKRKVVEFL

SEQ ID NO: 252698 - protein, 24 aa, Homo sapiens
  Native (MAGC1_HUMAN)
RYEFLWGPRAHSEVIKRKVVEFLA

SEQ ID NO: 252699 - protein, 25 aa, Homo sapiens
  Native (MAGC1_HUMAN)
RYEFLWGPRAHSEVIKRKVVEFLAM

SEQ ID NO: 252700 - protein, 13 aa, Homo sapiens
  Native (MAGC1_HUMAN)
RYTGYFPVIFRKA

SEQ ID NO: 252701 - protein, 14 aa, Homo sapiens
  Native (MAGC1_HUMAN)
RYTGYFPVIFRKAR

SEQ ID NO: 252702 - protein, 15 aa, Homo sapiens
  Native (MAGC1_HUMAN)
RYTGYFPVIFRKARE

SEQ ID NO: 252703 - protein, 16 aa, Homo sapiens
  Native (MAGC1_HUMAN)
RYTGYFPVIFRKAREF

SEQ ID NO: 252704 - protein, 17 aa, Homo sapiens
  Native (MAGC1_HUMAN)
RYTGYFPVIFRKAREFI

SEQ ID NO: 252705 - protein, 18 aa, Homo sapiens
  Native (MAGC1_HUMAN)
RYTGYFPVIFRKAREFIE

SEQ ID NO: 252706 - protein, 19 aa, Homo sapiens
  Native (MAGC1_HUMAN)
RYTGYFPVIFRKAREFIEI

SEQ ID NO: 252707 - protein, 20 aa, Homo sapiens
  Native (MAGC1_HUMAN)
RYTGYFPVIFRKAREFIEIL

SEQ ID NO: 252708 - protein, 21 aa, Homo sapiens
  Native (MAGC1_HUMAN)
RYTGYFPVIFRKAREFIEILF

SEQ ID NO: 252709 - protein, 22 aa, Homo sapiens
  Native (MAGC1_HUMAN)
RYTGYFPVIFRKAREFIEILFG

SEQ ID NO: 252710 - protein, 23 aa, Homo sapiens
  Native (MAGC1_HUMAN)
RYTGYFPVIFRKAREFIEILFGI

SEQ ID NO: 252711 - protein, 24 aa, Homo sapiens
  Native (MAGC1_HUMAN)
RYTGYFPVIFRKAREFIEILFGIS

SEQ ID NO: 252712 - protein, 25 aa, Homo sapiens
  Native (MAGC1_HUMAN)
RYTGYFPVIFRKAREFIEILFGISL

SEQ ID NO: 252713 - protein, 13 aa, Homo sapiens
  Native (MAGC1_HUMAN)
SAASSSTLVSIFQ

SEQ ID NO: 252714 - protein, 14 aa, Homo sapiens
  Native (MAGC1_HUMAN)
SAASSSTLVSIFQS

SEQ ID NO: 252715 - protein, 15 aa, Homo sapiens
  Native (MAGC1_HUMAN)
SAASSSTLVSIFQSS

SEQ ID NO: 252716 - protein, 16 aa, Homo sapiens
  Native (MAGC1_HUMAN)
SAASSSTLVSIFQSSP

SEQ ID NO: 252717 - protein, 17 aa, Homo sapiens
  Native (MAGC1_HUMAN)
SAASSSTLVSIFQSSPE

SEQ ID NO: 252718 - protein, 18 aa, Homo sapiens
  Native (MAGC1_HUMAN)
SAASSSTLVSIFQSSPES

SEQ ID NO: 252719 - protein, 19 aa, Homo sapiens
  Native (MAGC1_HUMAN)
SAASSSTLVSIFQSSPEST

SEQ ID NO: 252720 - protein, 20 aa, Homo sapiens
  Native (MAGC1_HUMAN)
SAASSSTLVSIFQSSPESTQ

SEQ ID NO: 252721 - protein, 21 aa, Homo sapiens
  Native (MAGC1_HUMAN)
SAASSSTLVSIFQSSPESTQS

SEQ ID NO: 252722 - protein, 22 aa, Homo sapiens
  Native (MAGC1_HUMAN)
SAASSSTLVSIFQSSPESTQSP

SEQ ID NO: 252723 - protein, 23 aa, Homo sapiens
  Native (MAGC1_HUMAN)
SAASSSTLVSIFQSSPESTQSPF

SEQ ID NO: 252724 - protein, 24 aa, Homo sapiens
  Native (MAGC1_HUMAN)
SAASSSTLVSIFQSSPESTQSPFE

SEQ ID NO: 252725 - protein, 25 aa, Homo sapiens
  Native (MAGC1_HUMAN)
SAASSSTLVSIFQSSPESTQSPFEG

SEQ ID NO: 252726 - protein, 14 aa, Homo sapiens
  Native (MAGC1_HUMAN)
SAFEGFPQSPLQIP

SEQ ID NO: 252727 - protein, 15 aa, Homo sapiens
  Native (MAGC1_HUMAN)
SAFEGFPQSPLQIPV

SEQ ID NO: 252728 - protein, 16 aa, Homo sapiens
  Native (MAGC1_HUMAN)
SAFEGFPQSPLQIPVS

SEQ ID NO: 252729 - protein, 17 aa, Homo sapiens
  Native (MAGC1_HUMAN)
SAFEGFPQSPLQIPVSS

SEQ ID NO: 252730 - protein, 19 aa, Homo sapiens
  Native (MAGC1_HUMAN)
SAFEGFPQSPLQIPVSSSF

SEQ ID NO: 252731 - protein, 20 aa, Homo sapiens
  Native (MAGC1_HUMAN)
SAFEGFPQSPLQIPVSSSFS

SEQ ID NO: 252732 - protein, 21 aa, Homo sapiens
  Native (MAGC1_HUMAN)
SAFEGFPQSPLQIPVSSSFSY

SEQ ID NO: 252733 - protein, 22 aa, Homo sapiens
  Native (MAGC1_HUMAN)
SAFEGFPQSPLQIPVSSSFSYT

SEQ ID NO: 252734 - protein, 23 aa, Homo sapiens
  Native (MAGC1_HUMAN)
SAFEGFPQSPLQIPVSSSFSYTL

SEQ ID NO: 252735 - protein, 24 aa, Homo sapiens
  Native (MAGC1_HUMAN)
SAFEGFPQSPLQIPVSSSFSYTLL

SEQ ID NO: 252736 - protein, 25 aa, Homo sapiens
  Native (MAGC1_HUMAN)
SAFEGFPQSPLQIPVSSSFSYTLLS

SEQ ID NO: 252737 - protein, 13 aa, Homo sapiens
  Native (MAGC1_HUMAN)
SALLSIFQSSPES

SEQ ID NO: 252738 - protein, 14 aa, Homo sapiens
  Native (MAGC1_HUMAN)
SALLSIFQSSPEST

SEQ ID NO: 252739 - protein, 15 aa, Homo sapiens
  Native (MAGC1_HUMAN)
SALLSIFQSSPESTQ

SEQ ID NO: 252740 - protein, 16 aa, Homo sapiens
  Native (MAGC1_HUMAN)
SALLSIFQSSPESTQS

SEQ ID NO: 252741 - protein, 17 aa, Homo sapiens
  Native (MAGC1_HUMAN)
SALLSIFQSSPESTQSP

SEQ ID NO: 252742 - protein, 18 aa, Homo sapiens
  Native (MAGC1_HUMAN)
SALLSIFQSSPESTQSPF

SEQ ID NO: 252743 - protein, 19 aa, Homo sapiens
  Native (MAGC1_HUMAN)
SALLSIFQSSPESTQSPFE

SEQ ID NO: 252744 - protein, 20 aa, Homo sapiens
  Native (MAGC1_HUMAN)
SALLSIFQSSPESTQSPFEG

SEQ ID NO: 252745 - protein, 21 aa, Homo sapiens
  Native (MAGC1_HUMAN)
SALLSIFQSSPESTQSPFEGF

SEQ ID NO: 252746 - protein, 22 aa, Homo sapiens
  Native (MAGC1_HUMAN)
SALLSIFQSSPESTQSPFEGFP

SEQ ID NO: 252747 - protein, 23 aa, Homo sapiens
  Native (MAGC1_HUMAN)
SALLSIFQSSPESTQSPFEGFPQ

SEQ ID NO: 252748 - protein, 24 aa, Homo sapiens
  Native (MAGC1_HUMAN)
SALLSIFQSSPESTQSPFEGFPQS

SEQ ID NO: 252749 - protein, 25 aa, Homo sapiens
  Native (MAGC1_HUMAN)
SALLSIFQSSPESTQSPFEGFPQSV

SEQ ID NO: 252750 - protein, 20 aa, Homo sapiens
  Native (MAGC1_HUMAN)
SAPEGEDSLSPLQIPQSPLE

SEQ ID NO: 252751 - protein, 21 aa, Homo sapiens
  Native (MAGC1_HUMAN)
SAPEGEDSLSPLQIPQSPLEG

SEQ ID NO: 252752 - protein, 22 aa, Homo sapiens
  Native (MAGC1_HUMAN)
SAPEGEDSLSPLQIPQSPLEGE

SEQ ID NO: 252753 - protein, 23 aa, Homo sapiens
  Native (MAGC1_HUMAN)
SAPEGEDSLSPLQIPQSPLEGED

SEQ ID NO: 252754 - protein, 24 aa, Homo sapiens
  Native (MAGC1_HUMAN)
SAPEGEDSLSPLQIPQSPLEGEDS

SEQ ID NO: 252755 - protein, 25 aa, Homo sapiens
  Native (MAGC1_HUMAN)
SAPEGEDSLSPLQIPQSPLEGEDSL

SEQ ID NO: 252756 - protein, 14 aa, Homo sapiens
  Native (MAGC1_HUMAN)
SAQSAFEGFPQSPL

SEQ ID NO: 252757 - protein, 15 aa, Homo sapiens
  Native (MAGC1_HUMAN)
SAQSAFEGFPQSPLQ

SEQ ID NO: 252758 - protein, 16 aa, Homo sapiens
  Native (MAGC1_HUMAN)
SAQSAFEGFPQSPLQI

SEQ ID NO: 252759 - protein, 17 aa, Homo sapiens
  Native (MAGC1_HUMAN)
SAQSAFEGFPQSPLQIP

SEQ ID NO: 252760 - protein, 19 aa, Homo sapiens
  Native (MAGC1_HUMAN)
SAQSAFEGFPQSPLQIPVS

SEQ ID NO: 252761 - protein, 20 aa, Homo sapiens
  Native (MAGC1_HUMAN)
SAQSAFEGFPQSPLQIPVSS

SEQ ID NO: 252762 - protein, 21 aa, Homo sapiens
  Native (MAGC1_HUMAN)
SAQSAFEGFPQSPLQIPVSSS

SEQ ID NO: 252763 - protein, 22 aa, Homo sapiens
  Native (MAGC1_HUMAN)
SAQSAFEGFPQSPLQIPVSSSF

SEQ ID NO: 252764 - protein, 23 aa, Homo sapiens
  Native (MAGC1_HUMAN)
SAQSAFEGFPQSPLQIPVSSSFS

SEQ ID NO: 252765 - protein, 24 aa, Homo sapiens
  Native (MAGC1_HUMAN)
SAQSAFEGFPQSPLQIPVSSSFSY

SEQ ID NO: 252766 - protein, 25 aa, Homo sapiens
  Native (MAGC1_HUMAN)
SAQSAFEGFPQSPLQIPVSSSFSYT

SEQ ID NO: 252767 - protein, 15 aa, Homo sapiens
  Native (MAGC1_HUMAN)
SAQSTFEGFPQSPLQ

SEQ ID NO: 252768 - protein, 16 aa, Homo sapiens
  Native (MAGC1_HUMAN)
SAQSTFEGFPQSPLQI

SEQ ID NO: 252769 - protein, 17 aa, Homo sapiens
  Native (MAGC1_HUMAN)
SAQSTFEGFPQSPLQIP

SEQ ID NO: 252770 - protein, 19 aa, Homo sapiens
  Native (MAGC1_HUMAN)
SAQSTFEGFPQSPLQIPGS

SEQ ID NO: 252771 - protein, 20 aa, Homo sapiens
  Native (MAGC1_HUMAN)
SAQSTFEGFPQSPLQIPGSP

SEQ ID NO: 252772 - protein, 21 aa, Homo sapiens
  Native (MAGC1_HUMAN)
SAQSTFEGFPQSPLQIPGSPS

SEQ ID NO: 252773 - protein, 22 aa, Homo sapiens
  Native (MAGC1_HUMAN)
SAQSTFEGFPQSPLQIPGSPSF

SEQ ID NO: 252774 - protein, 23 aa, Homo sapiens
  Native (MAGC1_HUMAN)
SAQSTFEGFPQSPLQIPGSPSFS

SEQ ID NO: 252775 - protein, 24 aa, Homo sapiens
  Native (MAGC1_HUMAN)
SAQSTFEGFPQSPLQIPGSPSFSS

SEQ ID NO: 252776 - protein, 25 aa, Homo sapiens
  Native (MAGC1_HUMAN)
SAQSTFEGFPQSPLQIPGSPSFSST

SEQ ID NO: 252777 - protein, 13 aa, Homo sapiens
  Native (MAGC1_HUMAN)
SASSSVMSPSFSS

SEQ ID NO: 252778 - protein, 14 aa, Homo sapiens
  Native (MAGC1_HUMAN)
SASSSVMSPSFSSE

SEQ ID NO: 252779 - protein, 14 aa, Homo sapiens
  Native (MAGC1_HUMAN)
SDDTLYPLQSPQSR

SEQ ID NO: 252780 - protein, 15 aa, Homo sapiens
  Native (MAGC1_HUMAN)
SDDTLYPLQSPQSRS

SEQ ID NO: 252781 - protein, 16 aa, Homo sapiens
  Native (MAGC1_HUMAN)
SDDTLYPLQSPQSRSE

SEQ ID NO: 252782 - protein, 17 aa, Homo sapiens
  Native (MAGC1_HUMAN)
SDDTLYPLQSPQSRSEG

SEQ ID NO: 252783 - protein, 19 aa, Homo sapiens
  Native (MAGC1_HUMAN)
SDDTLYPLQSPQSRSEGED

SEQ ID NO: 252784 - protein, 20 aa, Homo sapiens
  Native (MAGC1_HUMAN)
SDDTLYPLQSPQSRSEGEDS

SEQ ID NO: 252785 - protein, 21 aa, Homo sapiens
  Native (MAGC1_HUMAN)
SDDTLYPLQSPQSRSEGEDSS

SEQ ID NO: 252786 - protein, 22 aa, Homo sapiens
  Native (MAGC1_HUMAN)
SDDTLYPLQSPQSRSEGEDSSD

SEQ ID NO: 252787 - protein, 23 aa, Homo sapiens
  Native (MAGC1_HUMAN)
SDDTLYPLQSPQSRSEGEDSSDP

SEQ ID NO: 252788 - protein, 24 aa, Homo sapiens
  Native (MAGC1_HUMAN)
SDDTLYPLQSPQSRSEGEDSSDPL

SEQ ID NO: 252789 - protein, 25 aa, Homo sapiens
  Native (MAGC1_HUMAN)
SDDTLYPLQSPQSRSEGEDSSDPLQ

SEQ ID NO: 252790 - protein, 14 aa, Homo sapiens
  Native (MAGC1_HUMAN)
SDEQGMSQNRLLIL

SEQ ID NO: 252791 - protein, 15 aa, Homo sapiens
  Native (MAGC1_HUMAN)
SDEQGMSQNRLLILI

SEQ ID NO: 252792 - protein, 16 aa, Homo sapiens
  Native (MAGC1_HUMAN)
SDEQGMSQNRLLILIL

SEQ ID NO: 252793 - protein, 17 aa, Homo sapiens
  Native (MAGC1_HUMAN)
SDEQGMSQNRLLILILS

SEQ ID NO: 252794 - protein, 18 aa, Homo sapiens
  Native (MAGC1_HUMAN)
SDEQGMSQNRLLILILSI

SEQ ID NO: 252795 - protein, 19 aa, Homo sapiens
  Native (MAGC1_HUMAN)
SDEQGMSQNRLLILILSII

SEQ ID NO: 252796 - protein, 20 aa, Homo sapiens
  Native (MAGC1_HUMAN)
SDEQGMSQNRLLILILSIIF

SEQ ID NO: 252797 - protein, 21 aa, Homo sapiens
  Native (MAGC1_HUMAN)
SDEQGMSQNRLLILILSIIFI

SEQ ID NO: 252798 - protein, 22 aa, Homo sapiens
  Native (MAGC1_HUMAN)
SDEQGMSQNRLLILILSIIFIK

SEQ ID NO: 252799 - protein, 23 aa, Homo sapiens
  Native (MAGC1_HUMAN)
SDEQGMSQNRLLILILSIIFIKG

SEQ ID NO: 252800 - protein, 24 aa, Homo sapiens
  Native (MAGC1_HUMAN)
SDEQGMSQNRLLILILSIIFIKGT

SEQ ID NO: 252801 - protein, 25 aa, Homo sapiens
  Native (MAGC1_HUMAN)
SDEQGMSQNRLLILILSIIFIKGTY

SEQ ID NO: 252802 - protein, 16 aa, Homo sapiens
  Native (MAGC1_HUMAN)
SDSLTDSESLIESEPL

SEQ ID NO: 252803 - protein, 17 aa, Homo sapiens
  Native (MAGC1_HUMAN)
SDSLTDSESLIESEPLF

SEQ ID NO: 252804 - protein, 19 aa, Homo sapiens
  Native (MAGC1_HUMAN)
SDSLTDSESLIESEPLFTY

SEQ ID NO: 252805 - protein, 20 aa, Homo sapiens
  Native (MAGC1_HUMAN)
SDSLTDSESLIESEPLFTYT

SEQ ID NO: 252806 - protein, 21 aa, Homo sapiens
  Native (MAGC1_HUMAN)
SDSLTDSESLIESEPLFTYTL

SEQ ID NO: 252807 - protein, 22 aa, Homo sapiens
  Native (MAGC1_HUMAN)
SDSLTDSESLIESEPLFTYTLD

SEQ ID NO: 252808 - protein, 23 aa, Homo sapiens
  Native (MAGC1_HUMAN)
SDSLTDSESLIESEPLFTYTLDE

SEQ ID NO: 252809 - protein, 24 aa, Homo sapiens
  Native (MAGC1_HUMAN)
SDSLTDSESLIESEPLFTYTLDEK

SEQ ID NO: 252810 - protein, 25 aa, Homo sapiens
  Native (MAGC1_HUMAN)
SDSLTDSESLIESEPLFTYTLDEKV

SEQ ID NO: 252811 - protein, 24 aa, Homo sapiens
  Native (MAGC1_HUMAN)
SDTLLESDSLTDSESLIESEPLFT

SEQ ID NO: 252812 - protein, 25 aa, Homo sapiens
  Native (MAGC1_HUMAN)
SDTLLESDSLTDSESLIESEPLFTY

SEQ ID NO: 252813 - protein, 20 aa, Homo sapiens
  Native (MAGC1_HUMAN)
SEESSSPVDEYTSSSDTLLE

SEQ ID NO: 252814 - protein, 23 aa, Homo sapiens
  Native (MAGC1_HUMAN)
SEESSSPVDEYTSSSDTLLESDS

SEQ ID NO: 252815 - protein, 24 aa, Homo sapiens
  Native (MAGC1_HUMAN)
SEESSSPVDEYTSSSDTLLESDSL

SEQ ID NO: 252816 - protein, 25 aa, Homo sapiens
  Native (MAGC1_HUMAN)
SEESSSPVDEYTSSSDTLLESDSLT

SEQ ID NO: 252817 - protein, 14 aa, Homo sapiens
  Native (MAGC1_HUMAN)
SEEVIWDVLSGIGV

SEQ ID NO: 252818 - protein, 15 aa, Homo sapiens
  Native (MAGC1_HUMAN)
SEEVIWDVLSGIGVR

SEQ ID NO: 252819 - protein, 16 aa, Homo sapiens
  Native (MAGC1_HUMAN)
SEEVIWDVLSGIGVRA

SEQ ID NO: 252820 - protein, 17 aa, Homo sapiens
  Native (MAGC1_HUMAN)
SEEVIWDVLSGIGVRAG

SEQ ID NO: 252821 - protein, 18 aa, Homo sapiens
  Native (MAGC1_HUMAN)
SEEVIWDVLSGIGVRAGR

SEQ ID NO: 252822 - protein, 19 aa, Homo sapiens
  Native (MAGC1_HUMAN)
SEEVIWDVLSGIGVRAGRE

SEQ ID NO: 252823 - protein, 20 aa, Homo sapiens
  Native (MAGC1_HUMAN)
SEEVIWDVLSGIGVRAGREH

SEQ ID NO: 252824 - protein, 21 aa, Homo sapiens
  Native (MAGC1_HUMAN)
SEEVIWDVLSGIGVRAGREHF

SEQ ID NO: 252825 - protein, 22 aa, Homo sapiens
  Native (MAGC1_HUMAN)
SEEVIWDVLSGIGVRAGREHFA

SEQ ID NO: 252826 - protein, 23 aa, Homo sapiens
  Native (MAGC1_HUMAN)
SEEVIWDVLSGIGVRAGREHFAF

SEQ ID NO: 252827 - protein, 24 aa, Homo sapiens
  Native (MAGC1_HUMAN)
SEEVIWDVLSGIGVRAGREHFAFG

SEQ ID NO: 252828 - protein, 25 aa, Homo sapiens
  Native (MAGC1_HUMAN)
SEEVIWDVLSGIGVRAGREHFAFGE

SEQ ID NO: 252829 - protein, 19 aa, Homo sapiens
  Native (MAGC1_HUMAN)
SEGCLSDEQGMSQNRLLIL

SEQ ID NO: 252830 - protein, 20 aa, Homo sapiens
  Native (MAGC1_HUMAN)
SEGCLSDEQGMSQNRLLILI

SEQ ID NO: 252831 - protein, 21 aa, Homo sapiens
  Native (MAGC1_HUMAN)
SEGCLSDEQGMSQNRLLILIL

SEQ ID NO: 252832 - protein, 22 aa, Homo sapiens
  Native (MAGC1_HUMAN)
SEGCLSDEQGMSQNRLLILILS

SEQ ID NO: 252833 - protein, 23 aa, Homo sapiens
  Native (MAGC1_HUMAN)
SEGCLSDEQGMSQNRLLILILSI

SEQ ID NO: 252834 - protein, 24 aa, Homo sapiens
  Native (MAGC1_HUMAN)
SEGCLSDEQGMSQNRLLILILSII

SEQ ID NO: 252835 - protein, 25 aa, Homo sapiens
  Native (MAGC1_HUMAN)
SEGCLSDEQGMSQNRLLILILSIIF

SEQ ID NO: 252836 - protein, 13 aa, Homo sapiens
  Native (MAGC1_HUMAN)
SEPLFTYTLDEKV

SEQ ID NO: 252837 - protein, 14 aa, Homo sapiens
  Native (MAGC1_HUMAN)
SEPLFTYTLDEKVD

SEQ ID NO: 252838 - protein, 15 aa, Homo sapiens
  Native (MAGC1_HUMAN)
SEPLFTYTLDEKVDE

SEQ ID NO: 252839 - protein, 16 aa, Homo sapiens
  Native (MAGC1_HUMAN)
SEPLFTYTLDEKVDEL

SEQ ID NO: 252840 - protein, 17 aa, Homo sapiens
  Native (MAGC1_HUMAN)
SEPLFTYTLDEKVDELA

SEQ ID NO: 252841 - protein, 18 aa, Homo sapiens
  Native (MAGC1_HUMAN)
SEPLFTYTLDEKVDELAR

SEQ ID NO: 252842 - protein, 19 aa, Homo sapiens
  Native (MAGC1_HUMAN)
SEPLFTYTLDEKVDELARF

SEQ ID NO: 252843 - protein, 20 aa, Homo sapiens
  Native (MAGC1_HUMAN)
SEPLFTYTLDEKVDELARFL

SEQ ID NO: 252844 - protein, 21 aa, Homo sapiens
  Native (MAGC1_HUMAN)
SEPLFTYTLDEKVDELARFLL

SEQ ID NO: 252845 - protein, 22 aa, Homo sapiens
  Native (MAGC1_HUMAN)
SEPLFTYTLDEKVDELARFLLL

SEQ ID NO: 252846 - protein, 23 aa, Homo sapiens
  Native (MAGC1_HUMAN)
SEPLFTYTLDEKVDELARFLLLK

SEQ ID NO: 252847 - protein, 24 aa, Homo sapiens
  Native (MAGC1_HUMAN)
SEPLFTYTLDEKVDELARFLLLKY

SEQ ID NO: 252848 - protein, 25 aa, Homo sapiens
  Native (MAGC1_HUMAN)
SEPLFTYTLDEKVDELARFLLLKYQ

SEQ ID NO: 252849 - protein, 14 aa, Homo sapiens
  Native (MAGC1_HUMAN)
SERTQSTFEGFAQS

SEQ ID NO: 252850 - protein, 15 aa, Homo sapiens
  Native (MAGC1_HUMAN)
SERTQSTFEGFAQSS

SEQ ID NO: 252851 - protein, 16 aa, Homo sapiens
  Native (MAGC1_HUMAN)
SERTQSTFEGFAQSSL

SEQ ID NO: 252852 - protein, 17 aa, Homo sapiens
  Native (MAGC1_HUMAN)
SERTQSTFEGFAQSSLQ

SEQ ID NO: 252853 - protein, 18 aa, Homo sapiens
  Native (MAGC1_HUMAN)
SERTQSTFEGFAQSSLQI

SEQ ID NO: 252854 - protein, 19 aa, Homo sapiens
  Native (MAGC1_HUMAN)
SERTQSTFEGFAQSSLQIP

SEQ ID NO: 252855 - protein, 20 aa, Homo sapiens
  Native (MAGC1_HUMAN)
SERTQSTFEGFAQSSLQIPV

SEQ ID NO: 252856 - protein, 21 aa, Homo sapiens
  Native (MAGC1_HUMAN)
SERTQSTFEGFAQSSLQIPVS

SEQ ID NO: 252857 - protein, 22 aa, Homo sapiens
  Native (MAGC1_HUMAN)
SERTQSTFEGFAQSSLQIPVSP

SEQ ID NO: 252858 - protein, 23 aa, Homo sapiens
  Native (MAGC1_HUMAN)
SERTQSTFEGFAQSSLQIPVSPS

SEQ ID NO: 252859 - protein, 24 aa, Homo sapiens
  Native (MAGC1_HUMAN)
SERTQSTFEGFAQSSLQIPVSPSF

SEQ ID NO: 252860 - protein, 25 aa, Homo sapiens
  Native (MAGC1_HUMAN)
SERTQSTFEGFAQSSLQIPVSPSFS

SEQ ID NO: 252861 - protein, 13 aa, Homo sapiens
  Native (MAGC1_HUMAN)
SESLIESEPLFTY

SEQ ID NO: 252862 - protein, 14 aa, Homo sapiens
  Native (MAGC1_HUMAN)
SESLIESEPLFTYT

SEQ ID NO: 252863 - protein, 15 aa, Homo sapiens
  Native (MAGC1_HUMAN)
SESLIESEPLFTYTL

SEQ ID NO: 252864 - protein, 16 aa, Homo sapiens
  Native (MAGC1_HUMAN)
SESLIESEPLFTYTLD

SEQ ID NO: 252865 - protein, 17 aa, Homo sapiens
  Native (MAGC1_HUMAN)
SESLIESEPLFTYTLDE

SEQ ID NO: 252866 - protein, 18 aa, Homo sapiens
  Native (MAGC1_HUMAN)
SESLIESEPLFTYTLDEK

SEQ ID NO: 252867 - protein, 19 aa, Homo sapiens
  Native (MAGC1_HUMAN)
SESLIESEPLFTYTLDEKV

SEQ ID NO: 252868 - protein, 20 aa, Homo sapiens
  Native (MAGC1_HUMAN)
SESLIESEPLFTYTLDEKVD

SEQ ID NO: 252869 - protein, 21 aa, Homo sapiens
  Native (MAGC1_HUMAN)
SESLIESEPLFTYTLDEKVDE

SEQ ID NO: 252870 - protein, 22 aa, Homo sapiens
  Native (MAGC1_HUMAN)
SESLIESEPLFTYTLDEKVDEL

SEQ ID NO: 252871 - protein, 23 aa, Homo sapiens
  Native (MAGC1_HUMAN)
SESLIESEPLFTYTLDEKVDELA

SEQ ID NO: 252872 - protein, 24 aa, Homo sapiens
  Native (MAGC1_HUMAN)
SESLIESEPLFTYTLDEKVDELAR

SEQ ID NO: 252873 - protein, 25 aa, Homo sapiens
  Native (MAGC1_HUMAN)
SESLIESEPLFTYTLDEKVDELARF

SEQ ID NO: 252874 - protein, 14 aa, Homo sapiens
  Native (MAGC1_HUMAN)
SEVIKRKVVEFLAM

SEQ ID NO: 252875 - protein, 15 aa, Homo sapiens
  Native (MAGC1_HUMAN)
SEVIKRKVVEFLAML

SEQ ID NO: 252876 - protein, 16 aa, Homo sapiens
  Native (MAGC1_HUMAN)
SEVIKRKVVEFLAMLK

SEQ ID NO: 252877 - protein, 17 aa, Homo sapiens
  Native (MAGC1_HUMAN)
SEVIKRKVVEFLAMLKN

SEQ ID NO: 252878 - protein, 18 aa, Homo sapiens
  Native (MAGC1_HUMAN)
SEVIKRKVVEFLAMLKNT

SEQ ID NO: 252879 - protein, 19 aa, Homo sapiens
  Native (MAGC1_HUMAN)
SEVIKRKVVEFLAMLKNTV

SEQ ID NO: 252880 - protein, 20 aa, Homo sapiens
  Native (MAGC1_HUMAN)
SEVIKRKVVEFLAMLKNTVP

SEQ ID NO: 252881 - protein, 21 aa, Homo sapiens
  Native (MAGC1_HUMAN)
SEVIKRKVVEFLAMLKNTVPI

SEQ ID NO: 252882 - protein, 22 aa, Homo sapiens
  Native (MAGC1_HUMAN)
SEVIKRKVVEFLAMLKNTVPIT

SEQ ID NO: 252883 - protein, 23 aa, Homo sapiens
  Native (MAGC1_HUMAN)
SEVIKRKVVEFLAMLKNTVPITF

SEQ ID NO: 252884 - protein, 24 aa, Homo sapiens
  Native (MAGC1_HUMAN)
SEVIKRKVVEFLAMLKNTVPITFP

SEQ ID NO: 252885 - protein, 25 aa, Homo sapiens
  Native (MAGC1_HUMAN)
SEVIKRKVVEFLAMLKNTVPITFPS

SEQ ID NO: 252886 - protein, 13 aa, Homo sapiens
  Native (MAGC1_HUMAN)
SFFSSALLSIFQS

SEQ ID NO: 252887 - protein, 14 aa, Homo sapiens
  Native (MAGC1_HUMAN)
SFFSSALLSIFQSS

SEQ ID NO: 252888 - protein, 15 aa, Homo sapiens
  Native (MAGC1_HUMAN)
SFFSSALLSIFQSSP

SEQ ID NO: 252889 - protein, 16 aa, Homo sapiens
  Native (MAGC1_HUMAN)
SFFSSALLSIFQSSPE

SEQ ID NO: 252890 - protein, 17 aa, Homo sapiens
  Native (MAGC1_HUMAN)
SFFSSALLSIFQSSPES

SEQ ID NO: 252891 - protein, 18 aa, Homo sapiens
  Native (MAGC1_HUMAN)
SFFSSALLSIFQSSPEST

SEQ ID NO: 252892 - protein, 19 aa, Homo sapiens
  Native (MAGC1_HUMAN)
SFFSSALLSIFQSSPESTQ

SEQ ID NO: 252893 - protein, 20 aa, Homo sapiens
  Native (MAGC1_HUMAN)
SFFSSALLSIFQSSPESTQS

SEQ ID NO: 252894 - protein, 21 aa, Homo sapiens
  Native (MAGC1_HUMAN)
SFFSSALLSIFQSSPESTQSP

SEQ ID NO: 252895 - protein, 22 aa, Homo sapiens
  Native (MAGC1_HUMAN)
SFFSSALLSIFQSSPESTQSPF

SEQ ID NO: 252896 - protein, 23 aa, Homo sapiens
  Native (MAGC1_HUMAN)
SFFSSALLSIFQSSPESTQSPFE

SEQ ID NO: 252897 - protein, 24 aa, Homo sapiens
  Native (MAGC1_HUMAN)
SFFSSALLSIFQSSPESTQSPFEG

SEQ ID NO: 252898 - protein, 25 aa, Homo sapiens
  Native (MAGC1_HUMAN)
SFFSSALLSIFQSSPESTQSPFEGF

SEQ ID NO: 252899 - protein, 13 aa, Homo sapiens
  Native (MAGC1_HUMAN)
SFFSYTLASLLQS

SEQ ID NO: 252900 - protein, 14 aa, Homo sapiens
  Native (MAGC1_HUMAN)
SFFSYTLASLLQSS

SEQ ID NO: 252901 - protein, 15 aa, Homo sapiens
  Native (MAGC1_HUMAN)
SFFSYTLASLLQSSH

SEQ ID NO: 252902 - protein, 16 aa, Homo sapiens
  Native (MAGC1_HUMAN)
SFFSYTLASLLQSSHE

SEQ ID NO: 252903 - protein, 17 aa, Homo sapiens
  Native (MAGC1_HUMAN)
SFFSYTLASLLQSSHES

SEQ ID NO: 252904 - protein, 18 aa, Homo sapiens
  Native (MAGC1_HUMAN)
SFFSYTLASLLQSSHESP

SEQ ID NO: 252905 - protein, 19 aa, Homo sapiens
  Native (MAGC1_HUMAN)
SFFSYTLASLLQSSHESPQ

SEQ ID NO: 252906 - protein, 20 aa, Homo sapiens
  Native (MAGC1_HUMAN)
SFFSYTLASLLQSSHESPQS

SEQ ID NO: 252907 - protein, 21 aa, Homo sapiens
  Native (MAGC1_HUMAN)
SFFSYTLASLLQSSHESPQSP

SEQ ID NO: 252908 - protein, 22 aa, Homo sapiens
  Native (MAGC1_HUMAN)
SFFSYTLASLLQSSHESPQSPP

SEQ ID NO: 252909 - protein, 23 aa, Homo sapiens
  Native (MAGC1_HUMAN)
SFFSYTLASLLQSSHESPQSPPE

SEQ ID NO: 252910 - protein, 24 aa, Homo sapiens
  Native (MAGC1_HUMAN)
SFFSYTLASLLQSSHESPQSPPEG

SEQ ID NO: 252911 - protein, 25 aa, Homo sapiens
  Native (MAGC1_HUMAN)
SFFSYTLASLLQSSHESPQSPPEGP

SEQ ID NO: 252912 - protein, 13 aa, Homo sapiens
  Native (MAGC1_HUMAN)
SFPSSTSSSLSKS

SEQ ID NO: 252913 - protein, 14 aa, Homo sapiens
  Native (MAGC1_HUMAN)
SFPSSTSSSLSKSS

SEQ ID NO: 252914 - protein, 15 aa, Homo sapiens
  Native (MAGC1_HUMAN)
SFPSSTSSSLSKSSP

SEQ ID NO: 252915 - protein, 16 aa, Homo sapiens
  Native (MAGC1_HUMAN)
SFPSSTSSSLSKSSPE

SEQ ID NO: 252916 - protein, 17 aa, Homo sapiens
  Native (MAGC1_HUMAN)
SFPSSTSSSLSKSSPES

SEQ ID NO: 252917 - protein, 18 aa, Homo sapiens
  Native (MAGC1_HUMAN)
SFPSSTSSSLSKSSPESP

SEQ ID NO: 252918 - protein, 19 aa, Homo sapiens
  Native (MAGC1_HUMAN)
SFPSSTSSSLSKSSPESPL

SEQ ID NO: 252919 - protein, 20 aa, Homo sapiens
  Native (MAGC1_HUMAN)
SFPSSTSSSLSKSSPESPLQ

SEQ ID NO: 252920 - protein, 21 aa, Homo sapiens
  Native (MAGC1_HUMAN)
SFPSSTSSSLSKSSPESPLQS

SEQ ID NO: 252921 - protein, 22 aa, Homo sapiens
  Native (MAGC1_HUMAN)
SFPSSTSSSLSKSSPESPLQSP

SEQ ID NO: 252922 - protein, 23 aa, Homo sapiens
  Native (MAGC1_HUMAN)
SFPSSTSSSLSKSSPESPLQSPV

SEQ ID NO: 252923 - protein, 24 aa, Homo sapiens
  Native (MAGC1_HUMAN)
SFPSSTSSSLSKSSPESPLQSPVI

SEQ ID NO: 252924 - protein, 25 aa, Homo sapiens
  Native (MAGC1_HUMAN)
SFPSSTSSSLSKSSPESPLQSPVIS

SEQ ID NO: 252925 - protein, 14 aa, Homo sapiens
  Native (MAGC1_HUMAN)
SFPSSTSSSLSQSS

SEQ ID NO: 252926 - protein, 15 aa, Homo sapiens
  Native (MAGC1_HUMAN)
SFPSSTSSSLSQSSP

SEQ ID NO: 252927 - protein, 16 aa, Homo sapiens
  Native (MAGC1_HUMAN)
SFPSSTSSSLSQSSPV

SEQ ID NO: 252928 - protein, 17 aa, Homo sapiens
  Native (MAGC1_HUMAN)
SFPSSTSSSLSQSSPVS

SEQ ID NO: 252929 - protein, 18 aa, Homo sapiens
  Native (MAGC1_HUMAN)
SFPSSTSSSLSQSSPVSS

SEQ ID NO: 252930 - protein, 19 aa, Homo sapiens
  Native (MAGC1_HUMAN)
SFPSSTSSSLSQSSPVSSF

SEQ ID NO: 252931 - protein, 20 aa, Homo sapiens
  Native (MAGC1_HUMAN)
SFPSSTSSSLSQSSPVSSFP

SEQ ID NO: 252932 - protein, 21 aa, Homo sapiens
  Native (MAGC1_HUMAN)
SFPSSTSSSLSQSSPVSSFPS

SEQ ID NO: 252933 - protein, 22 aa, Homo sapiens
  Native (MAGC1_HUMAN)
SFPSSTSSSLSQSSPVSSFPSS

SEQ ID NO: 252934 - protein, 23 aa, Homo sapiens
  Native (MAGC1_HUMAN)
SFPSSTSSSLSQSSPVSSFPSST

SEQ ID NO: 252935 - protein, 24 aa, Homo sapiens
  Native (MAGC1_HUMAN)
SFPSSTSSSLSQSSPVSSFPSSTS

SEQ ID NO: 252936 - protein, 25 aa, Homo sapiens
  Native (MAGC1_HUMAN)
SFPSSTSSSLSQSSPVSSFPSSTSS

SEQ ID NO: 252937 - protein, 14 aa, Homo sapiens
  Native (MAGC1_HUMAN)
SFSERTQSTFEGFA

SEQ ID NO: 252938 - protein, 15 aa, Homo sapiens
  Native (MAGC1_HUMAN)
SFSERTQSTFEGFAQ

SEQ ID NO: 252939 - protein, 16 aa, Homo sapiens
  Native (MAGC1_HUMAN)
SFSERTQSTFEGFAQS

SEQ ID NO: 252940 - protein, 17 aa, Homo sapiens
  Native (MAGC1_HUMAN)
SFSERTQSTFEGFAQSS

SEQ ID NO: 252941 - protein, 18 aa, Homo sapiens
  Native (MAGC1_HUMAN)
SFSERTQSTFEGFAQSSL

SEQ ID NO: 252942 - protein, 19 aa, Homo sapiens
  Native (MAGC1_HUMAN)
SFSERTQSTFEGFAQSSLQ

SEQ ID NO: 252943 - protein, 20 aa, Homo sapiens
  Native (MAGC1_HUMAN)
SFSERTQSTFEGFAQSSLQI

SEQ ID NO: 252944 - protein, 21 aa, Homo sapiens
  Native (MAGC1_HUMAN)
SFSERTQSTFEGFAQSSLQIP

SEQ ID NO: 252945 - protein, 22 aa, Homo sapiens
  Native (MAGC1_HUMAN)
SFSERTQSTFEGFAQSSLQIPV

SEQ ID NO: 252946 - protein, 23 aa, Homo sapiens
  Native (MAGC1_HUMAN)
SFSERTQSTFEGFAQSSLQIPVS

SEQ ID NO: 252947 - protein, 24 aa, Homo sapiens
  Native (MAGC1_HUMAN)
SFSERTQSTFEGFAQSSLQIPVSP

SEQ ID NO: 252948 - protein, 25 aa, Homo sapiens
  Native (MAGC1_HUMAN)
SFSERTQSTFEGFAQSSLQIPVSPS

SEQ ID NO: 252949 - protein, 13 aa, Homo sapiens
  Native (MAGC1_HUMAN)
SFSSSTSLSPFSE

SEQ ID NO: 252950 - protein, 14 aa, Homo sapiens
  Native (MAGC1_HUMAN)
SFSSSTSLSPFSEE

SEQ ID NO: 252951 - protein, 15 aa, Homo sapiens
  Native (MAGC1_HUMAN)
SFSSSTSLSPFSEES

SEQ ID NO: 252952 - protein, 16 aa, Homo sapiens
  Native (MAGC1_HUMAN)
SFSSSTSLSPFSEESS

SEQ ID NO: 252953 - protein, 17 aa, Homo sapiens
  Native (MAGC1_HUMAN)
SFSSSTSLSPFSEESSS

SEQ ID NO: 252954 - protein, 19 aa, Homo sapiens
  Native (MAGC1_HUMAN)
SFSSSTSLSPFSEESSSPV

SEQ ID NO: 252955 - protein, 20 aa, Homo sapiens
  Native (MAGC1_HUMAN)
SFSSSTSLSPFSEESSSPVD

SEQ ID NO: 252956 - protein, 24 aa, Homo sapiens
  Native (MAGC1_HUMAN)
SFSSSTSLSPFSEESSSPVDEYTS

SEQ ID NO: 252957 - protein, 25 aa, Homo sapiens
  Native (MAGC1_HUMAN)
SFSSSTSLSPFSEESSSPVDEYTSS

SEQ ID NO: 252958 - protein, 13 aa, Homo sapiens
  Native (MAGC1_HUMAN)
SFSSTLLSIFQSS

SEQ ID NO: 252959 - protein, 14 aa, Homo sapiens
  Native (MAGC1_HUMAN)
SFSSTLLSIFQSSP

SEQ ID NO: 252960 - protein, 15 aa, Homo sapiens
  Native (MAGC1_HUMAN)
SFSSTLLSIFQSSPE

SEQ ID NO: 252961 - protein, 16 aa, Homo sapiens
  Native (MAGC1_HUMAN)
SFSSTLLSIFQSSPER

SEQ ID NO: 252962 - protein, 17 aa, Homo sapiens
  Native (MAGC1_HUMAN)
SFSSTLLSIFQSSPERT

SEQ ID NO: 252963 - protein, 18 aa, Homo sapiens
  Native (MAGC1_HUMAN)
SFSSTLLSIFQSSPERTQ

SEQ ID NO: 252964 - protein, 19 aa, Homo sapiens
  Native (MAGC1_HUMAN)
SFSSTLLSIFQSSPERTQS

SEQ ID NO: 252965 - protein, 20 aa, Homo sapiens
  Native (MAGC1_HUMAN)
SFSSTLLSIFQSSPERTQST

SEQ ID NO: 252966 - protein, 21 aa, Homo sapiens
  Native (MAGC1_HUMAN)
SFSSTLLSIFQSSPERTQSTF

SEQ ID NO: 252967 - protein, 22 aa, Homo sapiens
  Native (MAGC1_HUMAN)
SFSSTLLSIFQSSPERTQSTFE

SEQ ID NO: 252968 - protein, 23 aa, Homo sapiens
  Native (MAGC1_HUMAN)
SFSSTLLSIFQSSPERTQSTFEG

SEQ ID NO: 252969 - protein, 24 aa, Homo sapiens
  Native (MAGC1_HUMAN)
SFSSTLLSIFQSSPERTQSTFEGF

SEQ ID NO: 252970 - protein, 25 aa, Homo sapiens
  Native (MAGC1_HUMAN)
SFSSTLLSIFQSSPERTQSTFEGFA

SEQ ID NO: 252971 - protein, 16 aa, Homo sapiens
  Native (MAGC1_HUMAN)
SFSSTLLSIFQSSPES

SEQ ID NO: 252972 - protein, 17 aa, Homo sapiens
  Native (MAGC1_HUMAN)
SFSSTLLSIFQSSPESA

SEQ ID NO: 252973 - protein, 18 aa, Homo sapiens
  Native (MAGC1_HUMAN)
SFSSTLLSIFQSSPESAQ

SEQ ID NO: 252974 - protein, 19 aa, Homo sapiens
  Native (MAGC1_HUMAN)
SFSSTLLSIFQSSPESAQS

SEQ ID NO: 252975 - protein, 20 aa, Homo sapiens
  Native (MAGC1_HUMAN)
SFSSTLLSIFQSSPESAQST

SEQ ID NO: 252976 - protein, 21 aa, Homo sapiens
  Native (MAGC1_HUMAN)
SFSSTLLSIFQSSPESAQSTF

SEQ ID NO: 252977 - protein, 22 aa, Homo sapiens
  Native (MAGC1_HUMAN)
SFSSTLLSIFQSSPESAQSTFE

SEQ ID NO: 252978 - protein, 23 aa, Homo sapiens
  Native (MAGC1_HUMAN)
SFSSTLLSIFQSSPESAQSTFEG

SEQ ID NO: 252979 - protein, 24 aa, Homo sapiens
  Native (MAGC1_HUMAN)
SFSSTLLSIFQSSPESAQSTFEGF

SEQ ID NO: 252980 - protein, 25 aa, Homo sapiens
  Native (MAGC1_HUMAN)
SFSSTLLSIFQSSPESAQSTFEGFP

SEQ ID NO: 252981 - protein, 13 aa, Homo sapiens
  Native (MAGC1_HUMAN)
SFSSTLLSILQSS

SEQ ID NO: 252982 - protein, 14 aa, Homo sapiens
  Native (MAGC1_HUMAN)
SFSSTLLSILQSSP

SEQ ID NO: 252983 - protein, 15 aa, Homo sapiens
  Native (MAGC1_HUMAN)
SFSSTLLSILQSSPE

SEQ ID NO: 252984 - protein, 16 aa, Homo sapiens
  Native (MAGC1_HUMAN)
SFSSTLLSILQSSPES

SEQ ID NO: 252985 - protein, 17 aa, Homo sapiens
  Native (MAGC1_HUMAN)
SFSSTLLSILQSSPESA

SEQ ID NO: 252986 - protein, 18 aa, Homo sapiens
  Native (MAGC1_HUMAN)
SFSSTLLSILQSSPESAQ

SEQ ID NO: 252987 - protein, 19 aa, Homo sapiens
  Native (MAGC1_HUMAN)
SFSSTLLSILQSSPESAQS

SEQ ID NO: 252988 - protein, 20 aa, Homo sapiens
  Native (MAGC1_HUMAN)
SFSSTLLSILQSSPESAQSA

SEQ ID NO: 252989 - protein, 21 aa, Homo sapiens
  Native (MAGC1_HUMAN)
SFSSTLLSILQSSPESAQSAF

SEQ ID NO: 252990 - protein, 22 aa, Homo sapiens
  Native (MAGC1_HUMAN)
SFSSTLLSILQSSPESAQSAFE

SEQ ID NO: 252991 - protein, 23 aa, Homo sapiens
  Native (MAGC1_HUMAN)
SFSSTLLSILQSSPESAQSAFEG

SEQ ID NO: 252992 - protein, 24 aa, Homo sapiens
  Native (MAGC1_HUMAN)
SFSSTLLSILQSSPESAQSAFEGF

SEQ ID NO: 252993 - protein, 25 aa, Homo sapiens
  Native (MAGC1_HUMAN)
SFSSTLLSILQSSPESAQSAFEGFP

SEQ ID NO: 252994 - protein, 13 aa, Homo sapiens
  Native (MAGC1_HUMAN)
SFSSTLLSLFQSS

SEQ ID NO: 252995 - protein, 14 aa, Homo sapiens
  Native (MAGC1_HUMAN)
SFSSTLLSLFQSSP

SEQ ID NO: 252996 - protein, 15 aa, Homo sapiens
  Native (MAGC1_HUMAN)
SFSSTLLSLFQSSPE

SEQ ID NO: 252997 - protein, 16 aa, Homo sapiens
  Native (MAGC1_HUMAN)
SFSSTLLSLFQSSPER

SEQ ID NO: 252998 - protein, 17 aa, Homo sapiens
  Native (MAGC1_HUMAN)
SFSSTLLSLFQSSPERT

SEQ ID NO: 252999 - protein, 18 aa, Homo sapiens
  Native (MAGC1_HUMAN)
SFSSTLLSLFQSSPERTH

SEQ ID NO: 253000 - protein, 19 aa, Homo sapiens
  Native (MAGC1_HUMAN)
SFSSTLLSLFQSSPERTHS

SEQ ID NO: 253001 - protein, 20 aa, Homo sapiens
  Native (MAGC1_HUMAN)
SFSSTLLSLFQSSPERTHST

SEQ ID NO: 253002 - protein, 21 aa, Homo sapiens
  Native (MAGC1_HUMAN)
SFSSTLLSLFQSSPERTHSTF

SEQ ID NO: 253003 - protein, 22 aa, Homo sapiens
  Native (MAGC1_HUMAN)
SFSSTLLSLFQSSPERTHSTFE

SEQ ID NO: 253004 - protein, 23 aa, Homo sapiens
  Native (MAGC1_HUMAN)
SFSSTLLSLFQSSPERTHSTFEG

SEQ ID NO: 253005 - protein, 24 aa, Homo sapiens
  Native (MAGC1_HUMAN)
SFSSTLLSLFQSSPERTHSTFEGF

SEQ ID NO: 253006 - protein, 25 aa, Homo sapiens
  Native (MAGC1_HUMAN)
SFSSTLLSLFQSSPERTHSTFEGFP

SEQ ID NO: 253007 - protein, 13 aa, Homo sapiens
  Native (MAGC1_HUMAN)
SFSSTLVSLFQSS

SEQ ID NO: 253008 - protein, 14 aa, Homo sapiens
  Native (MAGC1_HUMAN)
SFSSTLVSLFQSSP

SEQ ID NO: 253009 - protein, 15 aa, Homo sapiens
  Native (MAGC1_HUMAN)
SFSSTLVSLFQSSPE

SEQ ID NO: 253010 - protein, 16 aa, Homo sapiens
  Native (MAGC1_HUMAN)
SFSSTLVSLFQSSPER

SEQ ID NO: 253011 - protein, 17 aa, Homo sapiens
  Native (MAGC1_HUMAN)
SFSSTLVSLFQSSPERT

SEQ ID NO: 253012 - protein, 18 aa, Homo sapiens
  Native (MAGC1_HUMAN)
SFSSTLVSLFQSSPERTQ

SEQ ID NO: 253013 - protein, 19 aa, Homo sapiens
  Native (MAGC1_HUMAN)
SFSSTLVSLFQSSPERTQS

SEQ ID NO: 253014 - protein, 20 aa, Homo sapiens
  Native (MAGC1_HUMAN)
SFSSTLVSLFQSSPERTQST

SEQ ID NO: 253015 - protein, 21 aa, Homo sapiens
  Native (MAGC1_HUMAN)
SFSSTLVSLFQSSPERTQSTF

SEQ ID NO: 253016 - protein, 22 aa, Homo sapiens
  Native (MAGC1_HUMAN)
SFSSTLVSLFQSSPERTQSTFE

SEQ ID NO: 253017 - protein, 23 aa, Homo sapiens
  Native (MAGC1_HUMAN)
SFSSTLVSLFQSSPERTQSTFEG

SEQ ID NO: 253018 - protein, 24 aa, Homo sapiens
  Native (MAGC1_HUMAN)
SFSSTLVSLFQSSPERTQSTFEGF

SEQ ID NO: 253019 - protein, 25 aa, Homo sapiens
  Native (MAGC1_HUMAN)
SFSSTLVSLFQSSPERTQSTFEGFP

SEQ ID NO: 253020 - protein, 13 aa, Homo sapiens
  Native (MAGC1_HUMAN)
SFSYTLLSLFQSS

SEQ ID NO: 253021 - protein, 14 aa, Homo sapiens
  Native (MAGC1_HUMAN)
SFSYTLLSLFQSSP

SEQ ID NO: 253022 - protein, 15 aa, Homo sapiens
  Native (MAGC1_HUMAN)
SFSYTLLSLFQSSPE

SEQ ID NO: 253023 - protein, 16 aa, Homo sapiens
  Native (MAGC1_HUMAN)
SFSYTLLSLFQSSPER

SEQ ID NO: 253024 - protein, 17 aa, Homo sapiens
  Native (MAGC1_HUMAN)
SFSYTLLSLFQSSPERT

SEQ ID NO: 253025 - protein, 18 aa, Homo sapiens
  Native (MAGC1_HUMAN)
SFSYTLLSLFQSSPERTH

SEQ ID NO: 253026 - protein, 19 aa, Homo sapiens
  Native (MAGC1_HUMAN)
SFSYTLLSLFQSSPERTHS

SEQ ID NO: 253027 - protein, 20 aa, Homo sapiens
  Native (MAGC1_HUMAN)
SFSYTLLSLFQSSPERTHST

SEQ ID NO: 253028 - protein, 21 aa, Homo sapiens
  Native (MAGC1_HUMAN)
SFSYTLLSLFQSSPERTHSTF

SEQ ID NO: 253029 - protein, 22 aa, Homo sapiens
  Native (MAGC1_HUMAN)
SFSYTLLSLFQSSPERTHSTFE

SEQ ID NO: 253030 - protein, 23 aa, Homo sapiens
  Native (MAGC1_HUMAN)
SFSYTLLSLFQSSPERTHSTFEG

SEQ ID NO: 253031 - protein, 24 aa, Homo sapiens
  Native (MAGC1_HUMAN)
SFSYTLLSLFQSSPERTHSTFEGF

SEQ ID NO: 253032 - protein, 25 aa, Homo sapiens
  Native (MAGC1_HUMAN)
SFSYTLLSLFQSSPERTHSTFEGFP

SEQ ID NO: 253033 - protein, 14 aa, Homo sapiens
  Native (MAGC1_HUMAN)
SGIGVRAGREHFAF

SEQ ID NO: 253034 - protein, 15 aa, Homo sapiens
  Native (MAGC1_HUMAN)
SGIGVRAGREHFAFG

SEQ ID NO: 253035 - protein, 16 aa, Homo sapiens
  Native (MAGC1_HUMAN)
SGIGVRAGREHFAFGE

SEQ ID NO: 253036 - protein, 17 aa, Homo sapiens
  Native (MAGC1_HUMAN)
SGIGVRAGREHFAFGEP

SEQ ID NO: 253037 - protein, 20 aa, Homo sapiens
  Native (MAGC1_HUMAN)
SGIGVRAGREHFAFGEPREL

SEQ ID NO: 253038 - protein, 21 aa, Homo sapiens
  Native (MAGC1_HUMAN)
SGIGVRAGREHFAFGEPRELL

SEQ ID NO: 253039 - protein, 22 aa, Homo sapiens
  Native (MAGC1_HUMAN)
SGIGVRAGREHFAFGEPRELLT

SEQ ID NO: 253040 - protein, 23 aa, Homo sapiens
  Native (MAGC1_HUMAN)
SGIGVRAGREHFAFGEPRELLTK

SEQ ID NO: 253041 - protein, 24 aa, Homo sapiens
  Native (MAGC1_HUMAN)
SGIGVRAGREHFAFGEPRELLTKV

SEQ ID NO: 253042 - protein, 25 aa, Homo sapiens
  Native (MAGC1_HUMAN)
SGIGVRAGREHFAFGEPRELLTKVW

SEQ ID NO: 253043 - protein, 13 aa, Homo sapiens
  Native (MAGC1_HUMAN)
SICSSSTPSSLPQ

SEQ ID NO: 253044 - protein, 14 aa, Homo sapiens
  Native (MAGC1_HUMAN)
SICSSSTPSSLPQS

SEQ ID NO: 253045 - protein, 15 aa, Homo sapiens
  Native (MAGC1_HUMAN)
SICSSSTPSSLPQSF

SEQ ID NO: 253046 - protein, 16 aa, Homo sapiens
  Native (MAGC1_HUMAN)
SICSSSTPSSLPQSFP

SEQ ID NO: 253047 - protein, 17 aa, Homo sapiens
  Native (MAGC1_HUMAN)
SICSSSTPSSLPQSFPE

SEQ ID NO: 253048 - protein, 18 aa, Homo sapiens
  Native (MAGC1_HUMAN)
SICSSSTPSSLPQSFPES

SEQ ID NO: 253049 - protein, 19 aa, Homo sapiens
  Native (MAGC1_HUMAN)
SICSSSTPSSLPQSFPESS

SEQ ID NO: 253050 - protein, 20 aa, Homo sapiens
  Native (MAGC1_HUMAN)
SICSSSTPSSLPQSFPESSQ

SEQ ID NO: 253051 - protein, 22 aa, Homo sapiens
  Native (MAGC1_HUMAN)
SICSSSTPSSLPQSFPESSQSP

SEQ ID NO: 253052 - protein, 23 aa, Homo sapiens
  Native (MAGC1_HUMAN)
SICSSSTPSSLPQSFPESSQSPP

SEQ ID NO: 253053 - protein, 24 aa, Homo sapiens
  Native (MAGC1_HUMAN)
SICSSSTPSSLPQSFPESSQSPPE

SEQ ID NO: 253054 - protein, 25 aa, Homo sapiens
  Native (MAGC1_HUMAN)
SICSSSTPSSLPQSFPESSQSPPEG

SEQ ID NO: 253055 - protein, 13 aa, Homo sapiens
  Native (MAGC1_HUMAN)
SICSSSTSLSLPQ

SEQ ID NO: 253056 - protein, 14 aa, Homo sapiens
  Native (MAGC1_HUMAN)
SICSSSTSLSLPQS

SEQ ID NO: 253057 - protein, 15 aa, Homo sapiens
  Native (MAGC1_HUMAN)
SICSSSTSLSLPQSF

SEQ ID NO: 253058 - protein, 16 aa, Homo sapiens
  Native (MAGC1_HUMAN)
SICSSSTSLSLPQSFP

SEQ ID NO: 253059 - protein, 17 aa, Homo sapiens
  Native (MAGC1_HUMAN)
SICSSSTSLSLPQSFPE

SEQ ID NO: 253060 - protein, 18 aa, Homo sapiens
  Native (MAGC1_HUMAN)
SICSSSTSLSLPQSFPES

SEQ ID NO: 253061 - protein, 19 aa, Homo sapiens
  Native (MAGC1_HUMAN)
SICSSSTSLSLPQSFPESP

SEQ ID NO: 253062 - protein, 20 aa, Homo sapiens
  Native (MAGC1_HUMAN)
SICSSSTSLSLPQSFPESPQ

SEQ ID NO: 253063 - protein, 21 aa, Homo sapiens
  Native (MAGC1_HUMAN)
SICSSSTSLSLPQSFPESPQS

SEQ ID NO: 253064 - protein, 22 aa, Homo sapiens
  Native (MAGC1_HUMAN)
SICSSSTSLSLPQSFPESPQSP

SEQ ID NO: 253065 - protein, 23 aa, Homo sapiens
  Native (MAGC1_HUMAN)
SICSSSTSLSLPQSFPESPQSPP

SEQ ID NO: 253066 - protein, 24 aa, Homo sapiens
  Native (MAGC1_HUMAN)
SICSSSTSLSLPQSFPESPQSPPE

SEQ ID NO: 253067 - protein, 25 aa, Homo sapiens
  Native (MAGC1_HUMAN)
SICSSSTSLSLPQSFPESPQSPPEG

SEQ ID NO: 253068 - protein, 15 aa, Homo sapiens
  Native (MAGC1_HUMAN)
SIFQSSPERTQSTFE

SEQ ID NO: 253069 - protein, 17 aa, Homo sapiens
  Native (MAGC1_HUMAN)
SIFQSSPERTQSTFEGF

SEQ ID NO: 253070 - protein, 19 aa, Homo sapiens
  Native (MAGC1_HUMAN)
SIFQSSPERTQSTFEGFAQ

SEQ ID NO: 253071 - protein, 20 aa, Homo sapiens
  Native (MAGC1_HUMAN)
SIFQSSPERTQSTFEGFAQS

SEQ ID NO: 253072 - protein, 21 aa, Homo sapiens
  Native (MAGC1_HUMAN)
SIFQSSPERTQSTFEGFAQSP

SEQ ID NO: 253073 - protein, 22 aa, Homo sapiens
  Native (MAGC1_HUMAN)
SIFQSSPERTQSTFEGFAQSPL

SEQ ID NO: 253074 - protein, 23 aa, Homo sapiens
  Native (MAGC1_HUMAN)
SIFQSSPERTQSTFEGFAQSPLQ

SEQ ID NO: 253075 - protein, 24 aa, Homo sapiens
  Native (MAGC1_HUMAN)
SIFQSSPERTQSTFEGFAQSPLQI

SEQ ID NO: 253076 - protein, 25 aa, Homo sapiens
  Native (MAGC1_HUMAN)
SIFQSSPERTQSTFEGFAQSPLQIP

SEQ ID NO: 253077 - protein, 14 aa, Homo sapiens
  Native (MAGC1_HUMAN)
SIFQSSPESAQSTF

SEQ ID NO: 253078 - protein, 15 aa, Homo sapiens
  Native (MAGC1_HUMAN)
SIFQSSPESAQSTFE

SEQ ID NO: 253079 - protein, 16 aa, Homo sapiens
  Native (MAGC1_HUMAN)
SIFQSSPESAQSTFEG

SEQ ID NO: 253080 - protein, 17 aa, Homo sapiens
  Native (MAGC1_HUMAN)
SIFQSSPESAQSTFEGF

SEQ ID NO: 253081 - protein, 20 aa, Homo sapiens
  Native (MAGC1_HUMAN)
SIFQSSPESAQSTFEGFPQS

SEQ ID NO: 253082 - protein, 22 aa, Homo sapiens
  Native (MAGC1_HUMAN)
SIFQSSPESAQSTFEGFPQSPL

SEQ ID NO: 253083 - protein, 23 aa, Homo sapiens
  Native (MAGC1_HUMAN)
SIFQSSPESAQSTFEGFPQSPLQ

SEQ ID NO: 253084 - protein, 24 aa, Homo sapiens
  Native (MAGC1_HUMAN)
SIFQSSPESAQSTFEGFPQSPLQI

SEQ ID NO: 253085 - protein, 25 aa, Homo sapiens
  Native (MAGC1_HUMAN)
SIFQSSPESAQSTFEGFPQSPLQIP

SEQ ID NO: 253086 - protein, 15 aa, Homo sapiens
  Native (MAGC1_HUMAN)
SIFQSSPESTQSPFE

SEQ ID NO: 253087 - protein, 16 aa, Homo sapiens
  Native (MAGC1_HUMAN)
SIFQSSPESTQSPFEG

SEQ ID NO: 253088 - protein, 24 aa, Homo sapiens
  Native (MAGC1_HUMAN)
SIFQSSPESTQSPFEGFPQSPLQI

SEQ ID NO: 253089 - protein, 25 aa, Homo sapiens
  Native (MAGC1_HUMAN)
SIFQSSPESTQSPFEGFPQSPLQIP

SEQ ID NO: 253090 - protein, 23 aa, Homo sapiens
  Native (MAGC1_HUMAN)
SIFQSSPESTQSPFEGFPQSVLQ

SEQ ID NO: 253091 - protein, 24 aa, Homo sapiens
  Native (MAGC1_HUMAN)
SIFQSSPESTQSPFEGFPQSVLQI

SEQ ID NO: 253092 - protein, 25 aa, Homo sapiens
  Native (MAGC1_HUMAN)
SIFQSSPESTQSPFEGFPQSVLQIP

SEQ ID NO: 253093 - protein, 13 aa, Homo sapiens
  Native (MAGC1_HUMAN)
SIIFIKGTYASEE

SEQ ID NO: 253094 - protein, 14 aa, Homo sapiens
  Native (MAGC1_HUMAN)
SIIFIKGTYASEEV

SEQ ID NO: 253095 - protein, 16 aa, Homo sapiens
  Native (MAGC1_HUMAN)
SIIFIKGTYASEEVIW

SEQ ID NO: 253096 - protein, 17 aa, Homo sapiens
  Native (MAGC1_HUMAN)
SIIFIKGTYASEEVIWD

SEQ ID NO: 253097 - protein, 18 aa, Homo sapiens
  Native (MAGC1_HUMAN)
SIIFIKGTYASEEVIWDV

SEQ ID NO: 253098 - protein, 19 aa, Homo sapiens
  Native (MAGC1_HUMAN)
SIIFIKGTYASEEVIWDVL

SEQ ID NO: 253099 - protein, 20 aa, Homo sapiens
  Native (MAGC1_HUMAN)
SIIFIKGTYASEEVIWDVLS

SEQ ID NO: 253100 - protein, 21 aa, Homo sapiens
  Native (MAGC1_HUMAN)
SIIFIKGTYASEEVIWDVLSG

SEQ ID NO: 253101 - protein, 22 aa, Homo sapiens
  Native (MAGC1_HUMAN)
SIIFIKGTYASEEVIWDVLSGI

SEQ ID NO: 253102 - protein, 23 aa, Homo sapiens
  Native (MAGC1_HUMAN)
SIIFIKGTYASEEVIWDVLSGIG

SEQ ID NO: 253103 - protein, 24 aa, Homo sapiens
  Native (MAGC1_HUMAN)
SIIFIKGTYASEEVIWDVLSGIGV

SEQ ID NO: 253104 - protein, 25 aa, Homo sapiens
  Native (MAGC1_HUMAN)
SIIFIKGTYASEEVIWDVLSGIGVR

SEQ ID NO: 253105 - protein, 14 aa, Homo sapiens
  Native (MAGC1_HUMAN)
SILQSSPESAQSAF

SEQ ID NO: 253106 - protein, 15 aa, Homo sapiens
  Native (MAGC1_HUMAN)
SILQSSPESAQSAFE

SEQ ID NO: 253107 - protein, 16 aa, Homo sapiens
  Native (MAGC1_HUMAN)
SILQSSPESAQSAFEG

SEQ ID NO: 253108 - protein, 17 aa, Homo sapiens
  Native (MAGC1_HUMAN)
SILQSSPESAQSAFEGF

SEQ ID NO: 253109 - protein, 19 aa, Homo sapiens
  Native (MAGC1_HUMAN)
SILQSSPESAQSAFEGFPQ

SEQ ID NO: 253110 - protein, 20 aa, Homo sapiens
  Native (MAGC1_HUMAN)
SILQSSPESAQSAFEGFPQS

SEQ ID NO: 253111 - protein, 22 aa, Homo sapiens
  Native (MAGC1_HUMAN)
SILQSSPESAQSAFEGFPQSPL

SEQ ID NO: 253112 - protein, 23 aa, Homo sapiens
  Native (MAGC1_HUMAN)
SILQSSPESAQSAFEGFPQSPLQ

SEQ ID NO: 253113 - protein, 24 aa, Homo sapiens
  Native (MAGC1_HUMAN)
SILQSSPESAQSAFEGFPQSPLQI

SEQ ID NO: 253114 - protein, 25 aa, Homo sapiens
  Native (MAGC1_HUMAN)
SILQSSPESAQSAFEGFPQSPLQIP

SEQ ID NO: 253115 - protein, 20 aa, Homo sapiens
  Native (MAGC1_HUMAN)
SKSSPESPLQSPVISFSSST

SEQ ID NO: 253116 - protein, 21 aa, Homo sapiens
  Native (MAGC1_HUMAN)
SKSSPESPLQSPVISFSSSTS

SEQ ID NO: 253117 - protein, 22 aa, Homo sapiens
  Native (MAGC1_HUMAN)
SKSSPESPLQSPVISFSSSTSL

SEQ ID NO: 253118 - protein, 23 aa, Homo sapiens
  Native (MAGC1_HUMAN)
SKSSPESPLQSPVISFSSSTSLS

SEQ ID NO: 253119 - protein, 24 aa, Homo sapiens
  Native (MAGC1_HUMAN)
SKSSPESPLQSPVISFSSSTSLSP

SEQ ID NO: 253120 - protein, 25 aa, Homo sapiens
  Native (MAGC1_HUMAN)
SKSSPESPLQSPVISFSSSTSLSPF

SEQ ID NO: 253121 - protein, 14 aa, Homo sapiens
  Native (MAGC1_HUMAN)
SLFQSFSERTQSTF

SEQ ID NO: 253122 - protein, 15 aa, Homo sapiens
  Native (MAGC1_HUMAN)
SLFQSFSERTQSTFE

SEQ ID NO: 253123 - protein, 16 aa, Homo sapiens
  Native (MAGC1_HUMAN)
SLFQSFSERTQSTFEG

SEQ ID NO: 253124 - protein, 17 aa, Homo sapiens
  Native (MAGC1_HUMAN)
SLFQSFSERTQSTFEGF

SEQ ID NO: 253125 - protein, 18 aa, Homo sapiens
  Native (MAGC1_HUMAN)
SLFQSFSERTQSTFEGFA

SEQ ID NO: 253126 - protein, 19 aa, Homo sapiens
  Native (MAGC1_HUMAN)
SLFQSFSERTQSTFEGFAQ

SEQ ID NO: 253127 - protein, 20 aa, Homo sapiens
  Native (MAGC1_HUMAN)
SLFQSFSERTQSTFEGFAQS

SEQ ID NO: 253128 - protein, 21 aa, Homo sapiens
  Native (MAGC1_HUMAN)
SLFQSFSERTQSTFEGFAQSS

SEQ ID NO: 253129 - protein, 22 aa, Homo sapiens
  Native (MAGC1_HUMAN)
SLFQSFSERTQSTFEGFAQSSL

SEQ ID NO: 253130 - protein, 23 aa, Homo sapiens
  Native (MAGC1_HUMAN)
SLFQSFSERTQSTFEGFAQSSLQ

SEQ ID NO: 253131 - protein, 24 aa, Homo sapiens
  Native (MAGC1_HUMAN)
SLFQSFSERTQSTFEGFAQSSLQI

SEQ ID NO: 253132 - protein, 25 aa, Homo sapiens
  Native (MAGC1_HUMAN)
SLFQSFSERTQSTFEGFAQSSLQIP

SEQ ID NO: 253133 - protein, 20 aa, Homo sapiens
  Native (MAGC1_HUMAN)
SLFQSSPECTQSTFEGFPQS

SEQ ID NO: 253134 - protein, 22 aa, Homo sapiens
  Native (MAGC1_HUMAN)
SLFQSSPECTQSTFEGFPQSPL

SEQ ID NO: 253135 - protein, 23 aa, Homo sapiens
  Native (MAGC1_HUMAN)
SLFQSSPECTQSTFEGFPQSPLQ

SEQ ID NO: 253136 - protein, 24 aa, Homo sapiens
  Native (MAGC1_HUMAN)
SLFQSSPECTQSTFEGFPQSPLQI

SEQ ID NO: 253137 - protein, 25 aa, Homo sapiens
  Native (MAGC1_HUMAN)
SLFQSSPECTQSTFEGFPQSPLQIP

SEQ ID NO: 253138 - protein, 15 aa, Homo sapiens
  Native (MAGC1_HUMAN)
SLFQSSPERTHSTFE

SEQ ID NO: 253139 - protein, 19 aa, Homo sapiens
  Native (MAGC1_HUMAN)
SLFQSSPERTHSTFEGFPQ

SEQ ID NO: 253140 - protein, 20 aa, Homo sapiens
  Native (MAGC1_HUMAN)
SLFQSSPERTHSTFEGFPQS

SEQ ID NO: 253141 - protein, 21 aa, Homo sapiens
  Native (MAGC1_HUMAN)
SLFQSSPERTHSTFEGFPQSL

SEQ ID NO: 253142 - protein, 22 aa, Homo sapiens
  Native (MAGC1_HUMAN)
SLFQSSPERTHSTFEGFPQSLL

SEQ ID NO: 253143 - protein, 23 aa, Homo sapiens
  Native (MAGC1_HUMAN)
SLFQSSPERTHSTFEGFPQSLLQ

SEQ ID NO: 253144 - protein, 24 aa, Homo sapiens
  Native (MAGC1_HUMAN)
SLFQSSPERTHSTFEGFPQSLLQI

SEQ ID NO: 253145 - protein, 25 aa, Homo sapiens
  Native (MAGC1_HUMAN)
SLFQSSPERTHSTFEGFPQSLLQIP

SEQ ID NO: 253146 - protein, 21 aa, Homo sapiens
  Native (MAGC1_HUMAN)
SLFQSSPERTHSTFEGFPQSP

SEQ ID NO: 253147 - protein, 22 aa, Homo sapiens
  Native (MAGC1_HUMAN)
SLFQSSPERTHSTFEGFPQSPL

SEQ ID NO: 253148 - protein, 23 aa, Homo sapiens
  Native (MAGC1_HUMAN)
SLFQSSPERTHSTFEGFPQSPLQ

SEQ ID NO: 253149 - protein, 24 aa, Homo sapiens
  Native (MAGC1_HUMAN)
SLFQSSPERTHSTFEGFPQSPLQI

SEQ ID NO: 253150 - protein, 25 aa, Homo sapiens
  Native (MAGC1_HUMAN)
SLFQSSPERTHSTFEGFPQSPLQIP

SEQ ID NO: 253151 - protein, 15 aa, Homo sapiens
  Native (MAGC1_HUMAN)
SLFQSSPERTQSTFE

SEQ ID NO: 253152 - protein, 17 aa, Homo sapiens
  Native (MAGC1_HUMAN)
SLFQSSPERTQSTFEGF

SEQ ID NO: 253153 - protein, 19 aa, Homo sapiens
  Native (MAGC1_HUMAN)
SLFQSSPERTQSTFEGFPQ

SEQ ID NO: 253154 - protein, 20 aa, Homo sapiens
  Native (MAGC1_HUMAN)
SLFQSSPERTQSTFEGFPQS

SEQ ID NO: 253155 - protein, 21 aa, Homo sapiens
  Native (MAGC1_HUMAN)
SLFQSSPERTQSTFEGFPQSP

SEQ ID NO: 253156 - protein, 22 aa, Homo sapiens
  Native (MAGC1_HUMAN)
SLFQSSPERTQSTFEGFPQSPL

SEQ ID NO: 253157 - protein, 23 aa, Homo sapiens
  Native (MAGC1_HUMAN)
SLFQSSPERTQSTFEGFPQSPLQ

SEQ ID NO: 253158 - protein, 24 aa, Homo sapiens
  Native (MAGC1_HUMAN)
SLFQSSPERTQSTFEGFPQSPLQI

SEQ ID NO: 253159 - protein, 25 aa, Homo sapiens
  Native (MAGC1_HUMAN)
SLFQSSPERTQSTFEGFPQSPLQIP

SEQ ID NO: 253160 - protein, 25 aa, Homo sapiens
  Native (MAGC1_HUMAN)
SLHFPQSPPEWEDSLSPLHFPQFPP

SEQ ID NO: 253161 - protein, 13 aa, Homo sapiens
  Native (MAGC1_HUMAN)
SLIESEPLFTYTL

SEQ ID NO: 253162 - protein, 14 aa, Homo sapiens
  Native (MAGC1_HUMAN)
SLIESEPLFTYTLD

SEQ ID NO: 253163 - protein, 15 aa, Homo sapiens
  Native (MAGC1_HUMAN)
SLIESEPLFTYTLDE

SEQ ID NO: 253164 - protein, 16 aa, Homo sapiens
  Native (MAGC1_HUMAN)
SLIESEPLFTYTLDEK

SEQ ID NO: 253165 - protein, 17 aa, Homo sapiens
  Native (MAGC1_HUMAN)
SLIESEPLFTYTLDEKV

SEQ ID NO: 253166 - protein, 18 aa, Homo sapiens
  Native (MAGC1_HUMAN)
SLIESEPLFTYTLDEKVD

SEQ ID NO: 253167 - protein, 19 aa, Homo sapiens
  Native (MAGC1_HUMAN)
SLIESEPLFTYTLDEKVDE

SEQ ID NO: 253168 - protein, 20 aa, Homo sapiens
  Native (MAGC1_HUMAN)
SLIESEPLFTYTLDEKVDEL

SEQ ID NO: 253169 - protein, 21 aa, Homo sapiens
  Native (MAGC1_HUMAN)
SLIESEPLFTYTLDEKVDELA

SEQ ID NO: 253170 - protein, 22 aa, Homo sapiens
  Native (MAGC1_HUMAN)
SLIESEPLFTYTLDEKVDELAR

SEQ ID NO: 253171 - protein, 23 aa, Homo sapiens
  Native (MAGC1_HUMAN)
SLIESEPLFTYTLDEKVDELARF

SEQ ID NO: 253172 - protein, 24 aa, Homo sapiens
  Native (MAGC1_HUMAN)
SLIESEPLFTYTLDEKVDELARFL

SEQ ID NO: 253173 - protein, 25 aa, Homo sapiens
  Native (MAGC1_HUMAN)
SLIESEPLFTYTLDEKVDELARFLL

SEQ ID NO: 253174 - protein, 14 aa, Homo sapiens
  Native (MAGC1_HUMAN)
SLLQIPMTSSFSST

SEQ ID NO: 253175 - protein, 15 aa, Homo sapiens
  Native (MAGC1_HUMAN)
SLLQIPMTSSFSSTL

SEQ ID NO: 253176 - protein, 16 aa, Homo sapiens
  Native (MAGC1_HUMAN)
SLLQIPMTSSFSSTLL

SEQ ID NO: 253177 - protein, 17 aa, Homo sapiens
  Native (MAGC1_HUMAN)
SLLQIPMTSSFSSTLLS

SEQ ID NO: 253178 - protein, 18 aa, Homo sapiens
  Native (MAGC1_HUMAN)
SLLQIPMTSSFSSTLLSI

SEQ ID NO: 253179 - protein, 19 aa, Homo sapiens
  Native (MAGC1_HUMAN)
SLLQIPMTSSFSSTLLSIF

SEQ ID NO: 253180 - protein, 20 aa, Homo sapiens
  Native (MAGC1_HUMAN)
SLLQIPMTSSFSSTLLSIFQ

SEQ ID NO: 253181 - protein, 21 aa, Homo sapiens
  Native (MAGC1_HUMAN)
SLLQIPMTSSFSSTLLSIFQS

SEQ ID NO: 253182 - protein, 22 aa, Homo sapiens
  Native (MAGC1_HUMAN)
SLLQIPMTSSFSSTLLSIFQSS

SEQ ID NO: 253183 - protein, 23 aa, Homo sapiens
  Native (MAGC1_HUMAN)
SLLQIPMTSSFSSTLLSIFQSSP

SEQ ID NO: 253184 - protein, 24 aa, Homo sapiens
  Native (MAGC1_HUMAN)
SLLQIPMTSSFSSTLLSIFQSSPE

SEQ ID NO: 253185 - protein, 25 aa, Homo sapiens
  Native (MAGC1_HUMAN)
SLLQIPMTSSFSSTLLSIFQSSPES

SEQ ID NO: 253186 - protein, 15 aa, Homo sapiens
  Native (MAGC1_HUMAN)
SLQIPVSPSFSSTLV

SEQ ID NO: 253187 - protein, 16 aa, Homo sapiens
  Native (MAGC1_HUMAN)
SLQIPVSPSFSSTLVS

SEQ ID NO: 253188 - protein, 17 aa, Homo sapiens
  Native (MAGC1_HUMAN)
SLQIPVSPSFSSTLVSL

SEQ ID NO: 253189 - protein, 18 aa, Homo sapiens
  Native (MAGC1_HUMAN)
SLQIPVSPSFSSTLVSLF

SEQ ID NO: 253190 - protein, 19 aa, Homo sapiens
  Native (MAGC1_HUMAN)
SLQIPVSPSFSSTLVSLFQ

SEQ ID NO: 253191 - protein, 20 aa, Homo sapiens
  Native (MAGC1_HUMAN)
SLQIPVSPSFSSTLVSLFQS

SEQ ID NO: 253192 - protein, 21 aa, Homo sapiens
  Native (MAGC1_HUMAN)
SLQIPVSPSFSSTLVSLFQSS

SEQ ID NO: 253193 - protein, 22 aa, Homo sapiens
  Native (MAGC1_HUMAN)
SLQIPVSPSFSSTLVSLFQSSP

SEQ ID NO: 253194 - protein, 23 aa, Homo sapiens
  Native (MAGC1_HUMAN)
SLQIPVSPSFSSTLVSLFQSSPE

SEQ ID NO: 253195 - protein, 24 aa, Homo sapiens
  Native (MAGC1_HUMAN)
SLQIPVSPSFSSTLVSLFQSSPER

SEQ ID NO: 253196 - protein, 25 aa, Homo sapiens
  Native (MAGC1_HUMAN)
SLQIPVSPSFSSTLVSLFQSSPERT

SEQ ID NO: 253197 - protein, 15 aa, Homo sapiens
  Native (MAGC1_HUMAN)
SLQSPVSICSSSTPS

SEQ ID NO: 253198 - protein, 16 aa, Homo sapiens
  Native (MAGC1_HUMAN)
SLQSPVSICSSSTPSS

SEQ ID NO: 253199 - protein, 17 aa, Homo sapiens
  Native (MAGC1_HUMAN)
SLQSPVSICSSSTPSSL

SEQ ID NO: 253200 - protein, 18 aa, Homo sapiens
  Native (MAGC1_HUMAN)
SLQSPVSICSSSTPSSLP

SEQ ID NO: 253201 - protein, 19 aa, Homo sapiens
  Native (MAGC1_HUMAN)
SLQSPVSICSSSTPSSLPQ

SEQ ID NO: 253202 - protein, 20 aa, Homo sapiens
  Native (MAGC1_HUMAN)
SLQSPVSICSSSTPSSLPQS

SEQ ID NO: 253203 - protein, 21 aa, Homo sapiens
  Native (MAGC1_HUMAN)
SLQSPVSICSSSTPSSLPQSF

SEQ ID NO: 253204 - protein, 22 aa, Homo sapiens
  Native (MAGC1_HUMAN)
SLQSPVSICSSSTPSSLPQSFP

SEQ ID NO: 253205 - protein, 23 aa, Homo sapiens
  Native (MAGC1_HUMAN)
SLQSPVSICSSSTPSSLPQSFPE

SEQ ID NO: 253206 - protein, 24 aa, Homo sapiens
  Native (MAGC1_HUMAN)
SLQSPVSICSSSTPSSLPQSFPES

SEQ ID NO: 253207 - protein, 25 aa, Homo sapiens
  Native (MAGC1_HUMAN)
SLQSPVSICSSSTPSSLPQSFPESS

SEQ ID NO: 253208 - protein, 14 aa, Homo sapiens
  Native (MAGC1_HUMAN)
SLQSPVSICSSSTS

SEQ ID NO: 253209 - protein, 15 aa, Homo sapiens
  Native (MAGC1_HUMAN)
SLQSPVSICSSSTSL

SEQ ID NO: 253210 - protein, 16 aa, Homo sapiens
  Native (MAGC1_HUMAN)
SLQSPVSICSSSTSLS

SEQ ID NO: 253211 - protein, 17 aa, Homo sapiens
  Native (MAGC1_HUMAN)
SLQSPVSICSSSTSLSL

SEQ ID NO: 253212 - protein, 18 aa, Homo sapiens
  Native (MAGC1_HUMAN)
SLQSPVSICSSSTSLSLP

SEQ ID NO: 253213 - protein, 19 aa, Homo sapiens
  Native (MAGC1_HUMAN)
SLQSPVSICSSSTSLSLPQ

SEQ ID NO: 253214 - protein, 20 aa, Homo sapiens
  Native (MAGC1_HUMAN)
SLQSPVSICSSSTSLSLPQS

SEQ ID NO: 253215 - protein, 21 aa, Homo sapiens
  Native (MAGC1_HUMAN)
SLQSPVSICSSSTSLSLPQSF

SEQ ID NO: 253216 - protein, 22 aa, Homo sapiens
  Native (MAGC1_HUMAN)
SLQSPVSICSSSTSLSLPQSFP

SEQ ID NO: 253217 - protein, 23 aa, Homo sapiens
  Native (MAGC1_HUMAN)
SLQSPVSICSSSTSLSLPQSFPE

SEQ ID NO: 253218 - protein, 24 aa, Homo sapiens
  Native (MAGC1_HUMAN)
SLQSPVSICSSSTSLSLPQSFPES

SEQ ID NO: 253219 - protein, 25 aa, Homo sapiens
  Native (MAGC1_HUMAN)
SLQSPVSICSSSTSLSLPQSFPESP

SEQ ID NO: 253220 - protein, 15 aa, Homo sapiens
  Native (MAGC1_HUMAN)
SLREVDPDDSYVFVN

SEQ ID NO: 253221 - protein, 19 aa, Homo sapiens
  Native (MAGC1_HUMAN)
SLREVDPDDSYVFVNTLDL

SEQ ID NO: 253222 - protein, 20 aa, Homo sapiens
  Native (MAGC1_HUMAN)
SLREVDPDDSYVFVNTLDLT

SEQ ID NO: 253223 - protein, 21 aa, Homo sapiens
  Native (MAGC1_HUMAN)
SLREVDPDDSYVFVNTLDLTS

SEQ ID NO: 253224 - protein, 22 aa, Homo sapiens
  Native (MAGC1_HUMAN)
SLREVDPDDSYVFVNTLDLTSE

SEQ ID NO: 253225 - protein, 23 aa, Homo sapiens
  Native (MAGC1_HUMAN)
SLREVDPDDSYVFVNTLDLTSEG

SEQ ID NO: 253226 - protein, 24 aa, Homo sapiens
  Native (MAGC1_HUMAN)
SLREVDPDDSYVFVNTLDLTSEGC

SEQ ID NO: 253227 - protein, 25 aa, Homo sapiens
  Native (MAGC1_HUMAN)
SLREVDPDDSYVFVNTLDLTSEGCL

SEQ ID NO: 253228 - protein, 20 aa, Homo sapiens
  Native (MAGC1_HUMAN)
SLSKSSPESPLQSPVISFSS

SEQ ID NO: 253229 - protein, 23 aa, Homo sapiens
  Native (MAGC1_HUMAN)
SLSKSSPESPLQSPVISFSSSTS

SEQ ID NO: 253230 - protein, 24 aa, Homo sapiens
  Native (MAGC1_HUMAN)
SLSKSSPESPLQSPVISFSSSTSL

SEQ ID NO: 253231 - protein, 25 aa, Homo sapiens
  Native (MAGC1_HUMAN)
SLSKSSPESPLQSPVISFSSSTSLS

SEQ ID NO: 253232 - protein, 15 aa, Homo sapiens
  Native (MAGC1_HUMAN)
SLSPFSEESSSPVDE

SEQ ID NO: 253233 - protein, 16 aa, Homo sapiens
  Native (MAGC1_HUMAN)
SLSPFSEESSSPVDEY

SEQ ID NO: 253234 - protein, 20 aa, Homo sapiens
  Native (MAGC1_HUMAN)
SLSPFSEESSSPVDEYTSSS

SEQ ID NO: 253235 - protein, 15 aa, Homo sapiens
  Native (MAGC1_HUMAN)
SLSPLHFPQFPPQGE

SEQ ID NO: 253236 - protein, 25 aa, Homo sapiens
  Native (MAGC1_HUMAN)
SLSPLHFPQFPPQGEDFQSSLQSPV

SEQ ID NO: 253237 - protein, 15 aa, Homo sapiens
  Native (MAGC1_HUMAN)
SLSPLQIPQSPLEGE

SEQ ID NO: 253238 - protein, 13 aa, Homo sapiens
  Native (MAGC1_HUMAN)
SLSQSSPVSSFPS

SEQ ID NO: 253239 - protein, 14 aa, Homo sapiens
  Native (MAGC1_HUMAN)
SLSQSSPVSSFPSS

SEQ ID NO: 253240 - protein, 15 aa, Homo sapiens
  Native (MAGC1_HUMAN)
SLSQSSPVSSFPSST

SEQ ID NO: 253241 - protein, 16 aa, Homo sapiens
  Native (MAGC1_HUMAN)
SLSQSSPVSSFPSSTS

SEQ ID NO: 253242 - protein, 17 aa, Homo sapiens
  Native (MAGC1_HUMAN)
SLSQSSPVSSFPSSTSS

SEQ ID NO: 253243 - protein, 18 aa, Homo sapiens
  Native (MAGC1_HUMAN)
SLSQSSPVSSFPSSTSSS

SEQ ID NO: 253244 - protein, 19 aa, Homo sapiens
  Native (MAGC1_HUMAN)
SLSQSSPVSSFPSSTSSSL

SEQ ID NO: 253245 - protein, 20 aa, Homo sapiens
  Native (MAGC1_HUMAN)
SLSQSSPVSSFPSSTSSSLS

SEQ ID NO: 253246 - protein, 21 aa, Homo sapiens
  Native (MAGC1_HUMAN)
SLSQSSPVSSFPSSTSSSLSK

SEQ ID NO: 253247 - protein, 22 aa, Homo sapiens
  Native (MAGC1_HUMAN)
SLSQSSPVSSFPSSTSSSLSKS

SEQ ID NO: 253248 - protein, 23 aa, Homo sapiens
  Native (MAGC1_HUMAN)
SLSQSSPVSSFPSSTSSSLSKSS

SEQ ID NO: 253249 - protein, 24 aa, Homo sapiens
  Native (MAGC1_HUMAN)
SLSQSSPVSSFPSSTSSSLSKSSP

SEQ ID NO: 253250 - protein, 25 aa, Homo sapiens
  Native (MAGC1_HUMAN)
SLSQSSPVSSFPSSTSSSLSKSSPE

SEQ ID NO: 253251 - protein, 15 aa, Homo sapiens
  Native (MAGC1_HUMAN)
SLSSLHFPQSPPEWE

SEQ ID NO: 253252 - protein, 15 aa, Homo sapiens
  Native (MAGC1_HUMAN)
SLTDSESLIESEPLF

SEQ ID NO: 253253 - protein, 16 aa, Homo sapiens
  Native (MAGC1_HUMAN)
SLTDSESLIESEPLFT

SEQ ID NO: 253254 - protein, 17 aa, Homo sapiens
  Native (MAGC1_HUMAN)
SLTDSESLIESEPLFTY

SEQ ID NO: 253255 - protein, 18 aa, Homo sapiens
  Native (MAGC1_HUMAN)
SLTDSESLIESEPLFTYT

SEQ ID NO: 253256 - protein, 19 aa, Homo sapiens
  Native (MAGC1_HUMAN)
SLTDSESLIESEPLFTYTL

SEQ ID NO: 253257 - protein, 20 aa, Homo sapiens
  Native (MAGC1_HUMAN)
SLTDSESLIESEPLFTYTLD

SEQ ID NO: 253258 - protein, 21 aa, Homo sapiens
  Native (MAGC1_HUMAN)
SLTDSESLIESEPLFTYTLDE

SEQ ID NO: 253259 - protein, 22 aa, Homo sapiens
  Native (MAGC1_HUMAN)
SLTDSESLIESEPLFTYTLDEK

SEQ ID NO: 253260 - protein, 23 aa, Homo sapiens
  Native (MAGC1_HUMAN)
SLTDSESLIESEPLFTYTLDEKV

SEQ ID NO: 253261 - protein, 24 aa, Homo sapiens
  Native (MAGC1_HUMAN)
SLTDSESLIESEPLFTYTLDEKVD

SEQ ID NO: 253262 - protein, 25 aa, Homo sapiens
  Native (MAGC1_HUMAN)
SLTDSESLIESEPLFTYTLDEKVDE

SEQ ID NO: 253263 - protein, 14 aa, Homo sapiens
  Native (MAGC1_HUMAN)
SMSPLYFPQSPLQG

SEQ ID NO: 253264 - protein, 15 aa, Homo sapiens
  Native (MAGC1_HUMAN)
SMSPLYFPQSPLQGE

SEQ ID NO: 253265 - protein, 16 aa, Homo sapiens
  Native (MAGC1_HUMAN)
SMSPLYFPQSPLQGEE

SEQ ID NO: 253266 - protein, 17 aa, Homo sapiens
  Native (MAGC1_HUMAN)
SMSPLYFPQSPLQGEEF

SEQ ID NO: 253267 - protein, 18 aa, Homo sapiens
  Native (MAGC1_HUMAN)
SMSPLYFPQSPLQGEEFQ

SEQ ID NO: 253268 - protein, 19 aa, Homo sapiens
  Native (MAGC1_HUMAN)
SMSPLYFPQSPLQGEEFQS

SEQ ID NO: 253269 - protein, 20 aa, Homo sapiens
  Native (MAGC1_HUMAN)
SMSPLYFPQSPLQGEEFQSS

SEQ ID NO: 253270 - protein, 21 aa, Homo sapiens
  Native (MAGC1_HUMAN)
SMSPLYFPQSPLQGEEFQSSL

SEQ ID NO: 253271 - protein, 22 aa, Homo sapiens
  Native (MAGC1_HUMAN)
SMSPLYFPQSPLQGEEFQSSLQ

SEQ ID NO: 253272 - protein, 23 aa, Homo sapiens
  Native (MAGC1_HUMAN)
SMSPLYFPQSPLQGEEFQSSLQS

SEQ ID NO: 253273 - protein, 24 aa, Homo sapiens
  Native (MAGC1_HUMAN)
SMSPLYFPQSPLQGEEFQSSLQSP

SEQ ID NO: 253274 - protein, 25 aa, Homo sapiens
  Native (MAGC1_HUMAN)
SMSPLYFPQSPLQGEEFQSSLQSPV

SEQ ID NO: 253275 - protein, 15 aa, Homo sapiens
  Native (MAGC1_HUMAN)
SPECTQSTFEGFPQS

SEQ ID NO: 253276 - protein, 17 aa, Homo sapiens
  Native (MAGC1_HUMAN)
SPECTQSTFEGFPQSPL

SEQ ID NO: 253277 - protein, 19 aa, Homo sapiens
  Native (MAGC1_HUMAN)
SPECTQSTFEGFPQSPLQI

SEQ ID NO: 253278 - protein, 20 aa, Homo sapiens
  Native (MAGC1_HUMAN)
SPECTQSTFEGFPQSPLQIP

SEQ ID NO: 253279 - protein, 21 aa, Homo sapiens
  Native (MAGC1_HUMAN)
SPECTQSTFEGFPQSPLQIPQ

SEQ ID NO: 253280 - protein, 22 aa, Homo sapiens
  Native (MAGC1_HUMAN)
SPECTQSTFEGFPQSPLQIPQS

SEQ ID NO: 253281 - protein, 23 aa, Homo sapiens
  Native (MAGC1_HUMAN)
SPECTQSTFEGFPQSPLQIPQSP

SEQ ID NO: 253282 - protein, 24 aa, Homo sapiens
  Native (MAGC1_HUMAN)
SPECTQSTFEGFPQSPLQIPQSPP

SEQ ID NO: 253283 - protein, 25 aa, Homo sapiens
  Native (MAGC1_HUMAN)
SPECTQSTFEGFPQSPLQIPQSPPE

SEQ ID NO: 253284 - protein, 20 aa, Homo sapiens
  Native (MAGC1_HUMAN)
SPEGKDSLSPLEISQSPPEG

SEQ ID NO: 253285 - protein, 15 aa, Homo sapiens
  Native (MAGC1_HUMAN)
SPERTHSTFEGFPQS

SEQ ID NO: 253286 - protein, 16 aa, Homo sapiens
  Native (MAGC1_HUMAN)
SPERTHSTFEGFPQSL

SEQ ID NO: 253287 - protein, 17 aa, Homo sapiens
  Native (MAGC1_HUMAN)
SPERTHSTFEGFPQSLL

SEQ ID NO: 253288 - protein, 18 aa, Homo sapiens
  Native (MAGC1_HUMAN)
SPERTHSTFEGFPQSLLQ

SEQ ID NO: 253289 - protein, 19 aa, Homo sapiens
  Native (MAGC1_HUMAN)
SPERTHSTFEGFPQSLLQI

SEQ ID NO: 253290 - protein, 20 aa, Homo sapiens
  Native (MAGC1_HUMAN)
SPERTHSTFEGFPQSLLQIP

SEQ ID NO: 253291 - protein, 21 aa, Homo sapiens
  Native (MAGC1_HUMAN)
SPERTHSTFEGFPQSLLQIPM

SEQ ID NO: 253292 - protein, 22 aa, Homo sapiens
  Native (MAGC1_HUMAN)
SPERTHSTFEGFPQSLLQIPMT

SEQ ID NO: 253293 - protein, 23 aa, Homo sapiens
  Native (MAGC1_HUMAN)
SPERTHSTFEGFPQSLLQIPMTS

SEQ ID NO: 253294 - protein, 24 aa, Homo sapiens
  Native (MAGC1_HUMAN)
SPERTHSTFEGFPQSLLQIPMTSS

SEQ ID NO: 253295 - protein, 25 aa, Homo sapiens
  Native (MAGC1_HUMAN)
SPERTHSTFEGFPQSLLQIPMTSSF

SEQ ID NO: 253296 - protein, 17 aa, Homo sapiens
  Native (MAGC1_HUMAN)
SPERTHSTFEGFPQSPL

SEQ ID NO: 253297 - protein, 19 aa, Homo sapiens
  Native (MAGC1_HUMAN)
SPERTHSTFEGFPQSPLQI

SEQ ID NO: 253298 - protein, 20 aa, Homo sapiens
  Native (MAGC1_HUMAN)
SPERTHSTFEGFPQSPLQIP

SEQ ID NO: 253299 - protein, 21 aa, Homo sapiens
  Native (MAGC1_HUMAN)
SPERTHSTFEGFPQSPLQIPM

SEQ ID NO: 253300 - protein, 22 aa, Homo sapiens
  Native (MAGC1_HUMAN)
SPERTHSTFEGFPQSPLQIPMT

SEQ ID NO: 253301 - protein, 23 aa, Homo sapiens
  Native (MAGC1_HUMAN)
SPERTHSTFEGFPQSPLQIPMTS

SEQ ID NO: 253302 - protein, 24 aa, Homo sapiens
  Native (MAGC1_HUMAN)
SPERTHSTFEGFPQSPLQIPMTSS

SEQ ID NO: 253303 - protein, 25 aa, Homo sapiens
  Native (MAGC1_HUMAN)
SPERTHSTFEGFPQSPLQIPMTSSF

SEQ ID NO: 253304 - protein, 21 aa, Homo sapiens
  Native (MAGC1_HUMAN)
SPERTHSTFEGFPQSPLQIPV

SEQ ID NO: 253305 - protein, 22 aa, Homo sapiens
  Native (MAGC1_HUMAN)
SPERTHSTFEGFPQSPLQIPVS

SEQ ID NO: 253306 - protein, 23 aa, Homo sapiens
  Native (MAGC1_HUMAN)
SPERTHSTFEGFPQSPLQIPVSS

SEQ ID NO: 253307 - protein, 24 aa, Homo sapiens
  Native (MAGC1_HUMAN)
SPERTHSTFEGFPQSPLQIPVSSS

SEQ ID NO: 253308 - protein, 25 aa, Homo sapiens
  Native (MAGC1_HUMAN)
SPERTHSTFEGFPQSPLQIPVSSSS

SEQ ID NO: 253309 - protein, 14 aa, Homo sapiens
  Native (MAGC1_HUMAN)
SPERTQSTFEGFAQ

SEQ ID NO: 253310 - protein, 15 aa, Homo sapiens
  Native (MAGC1_HUMAN)
SPERTQSTFEGFAQS

SEQ ID NO: 253311 - protein, 16 aa, Homo sapiens
  Native (MAGC1_HUMAN)
SPERTQSTFEGFAQSP

SEQ ID NO: 253312 - protein, 17 aa, Homo sapiens
  Native (MAGC1_HUMAN)
SPERTQSTFEGFAQSPL

SEQ ID NO: 253313 - protein, 18 aa, Homo sapiens
  Native (MAGC1_HUMAN)
SPERTQSTFEGFAQSPLQ

SEQ ID NO: 253314 - protein, 19 aa, Homo sapiens
  Native (MAGC1_HUMAN)
SPERTQSTFEGFAQSPLQI

SEQ ID NO: 253315 - protein, 20 aa, Homo sapiens
  Native (MAGC1_HUMAN)
SPERTQSTFEGFAQSPLQIP

SEQ ID NO: 253316 - protein, 21 aa, Homo sapiens
  Native (MAGC1_HUMAN)
SPERTQSTFEGFAQSPLQIPV

SEQ ID NO: 253317 - protein, 22 aa, Homo sapiens
  Native (MAGC1_HUMAN)
SPERTQSTFEGFAQSPLQIPVS

SEQ ID NO: 253318 - protein, 23 aa, Homo sapiens
  Native (MAGC1_HUMAN)
SPERTQSTFEGFAQSPLQIPVSP

SEQ ID NO: 253319 - protein, 24 aa, Homo sapiens
  Native (MAGC1_HUMAN)
SPERTQSTFEGFAQSPLQIPVSPS

SEQ ID NO: 253320 - protein, 25 aa, Homo sapiens
  Native (MAGC1_HUMAN)
SPERTQSTFEGFAQSPLQIPVSPSS

SEQ ID NO: 253321 - protein, 15 aa, Homo sapiens
  Native (MAGC1_HUMAN)
SPERTQSTFEGFPQS

SEQ ID NO: 253322 - protein, 16 aa, Homo sapiens
  Native (MAGC1_HUMAN)
SPERTQSTFEGFPQSP

SEQ ID NO: 253323 - protein, 17 aa, Homo sapiens
  Native (MAGC1_HUMAN)
SPERTQSTFEGFPQSPL

SEQ ID NO: 253324 - protein, 19 aa, Homo sapiens
  Native (MAGC1_HUMAN)
SPERTQSTFEGFPQSPLQI

SEQ ID NO: 253325 - protein, 20 aa, Homo sapiens
  Native (MAGC1_HUMAN)
SPERTQSTFEGFPQSPLQIP

SEQ ID NO: 253326 - protein, 21 aa, Homo sapiens
  Native (MAGC1_HUMAN)
SPERTQSTFEGFPQSPLQIPV

SEQ ID NO: 253327 - protein, 22 aa, Homo sapiens
  Native (MAGC1_HUMAN)
SPERTQSTFEGFPQSPLQIPVS

SEQ ID NO: 253328 - protein, 23 aa, Homo sapiens
  Native (MAGC1_HUMAN)
SPERTQSTFEGFPQSPLQIPVSS

SEQ ID NO: 253329 - protein, 24 aa, Homo sapiens
  Native (MAGC1_HUMAN)
SPERTQSTFEGFPQSPLQIPVSSS

SEQ ID NO: 253330 - protein, 25 aa, Homo sapiens
  Native (MAGC1_HUMAN)
SPERTQSTFEGFPQSPLQIPVSSSS

SEQ ID NO: 253331 - protein, 23 aa, Homo sapiens
  Native (MAGC1_HUMAN)
SPESAPEGEDSLSPLQIPQSPLE

SEQ ID NO: 253332 - protein, 24 aa, Homo sapiens
  Native (MAGC1_HUMAN)
SPESAPEGEDSLSPLQIPQSPLEG

SEQ ID NO: 253333 - protein, 25 aa, Homo sapiens
  Native (MAGC1_HUMAN)
SPESAPEGEDSLSPLQIPQSPLEGE

SEQ ID NO: 253334 - protein, 17 aa, Homo sapiens
  Native (MAGC1_HUMAN)
SPESAQSAFEGFPQSPL

SEQ ID NO: 253335 - protein, 19 aa, Homo sapiens
  Native (MAGC1_HUMAN)
SPESAQSAFEGFPQSPLQI

SEQ ID NO: 253336 - protein, 20 aa, Homo sapiens
  Native (MAGC1_HUMAN)
SPESAQSAFEGFPQSPLQIP

SEQ ID NO: 253337 - protein, 21 aa, Homo sapiens
  Native (MAGC1_HUMAN)
SPESAQSAFEGFPQSPLQIPV

SEQ ID NO: 253338 - protein, 22 aa, Homo sapiens
  Native (MAGC1_HUMAN)
SPESAQSAFEGFPQSPLQIPVS

SEQ ID NO: 253339 - protein, 23 aa, Homo sapiens
  Native (MAGC1_HUMAN)
SPESAQSAFEGFPQSPLQIPVSS

SEQ ID NO: 253340 - protein, 24 aa, Homo sapiens
  Native (MAGC1_HUMAN)
SPESAQSAFEGFPQSPLQIPVSSS

SEQ ID NO: 253341 - protein, 25 aa, Homo sapiens
  Native (MAGC1_HUMAN)
SPESAQSAFEGFPQSPLQIPVSSSF

SEQ ID NO: 253342 - protein, 17 aa, Homo sapiens
  Native (MAGC1_HUMAN)
SPESAQSTFEGFPQSPL

SEQ ID NO: 253343 - protein, 19 aa, Homo sapiens
  Native (MAGC1_HUMAN)
SPESAQSTFEGFPQSPLQI

SEQ ID NO: 253344 - protein, 20 aa, Homo sapiens
  Native (MAGC1_HUMAN)
SPESAQSTFEGFPQSPLQIP

SEQ ID NO: 253345 - protein, 21 aa, Homo sapiens
  Native (MAGC1_HUMAN)
SPESAQSTFEGFPQSPLQIPG

SEQ ID NO: 253346 - protein, 22 aa, Homo sapiens
  Native (MAGC1_HUMAN)
SPESAQSTFEGFPQSPLQIPGS

SEQ ID NO: 253347 - protein, 23 aa, Homo sapiens
  Native (MAGC1_HUMAN)
SPESAQSTFEGFPQSPLQIPGSP

SEQ ID NO: 253348 - protein, 24 aa, Homo sapiens
  Native (MAGC1_HUMAN)
SPESAQSTFEGFPQSPLQIPGSPS

SEQ ID NO: 253349 - protein, 25 aa, Homo sapiens
  Native (MAGC1_HUMAN)
SPESAQSTFEGFPQSPLQIPGSPSF

SEQ ID NO: 253350 - protein, 17 aa, Homo sapiens
  Native (MAGC1_HUMAN)
SPESDDTLYPLQSPQSR

SEQ ID NO: 253351 - protein, 19 aa, Homo sapiens
  Native (MAGC1_HUMAN)
SPESDDTLYPLQSPQSRSE

SEQ ID NO: 253352 - protein, 20 aa, Homo sapiens
  Native (MAGC1_HUMAN)
SPESDDTLYPLQSPQSRSEG

SEQ ID NO: 253353 - protein, 21 aa, Homo sapiens
  Native (MAGC1_HUMAN)
SPESDDTLYPLQSPQSRSEGE

SEQ ID NO: 253354 - protein, 22 aa, Homo sapiens
  Native (MAGC1_HUMAN)
SPESDDTLYPLQSPQSRSEGED

SEQ ID NO: 253355 - protein, 23 aa, Homo sapiens
  Native (MAGC1_HUMAN)
SPESDDTLYPLQSPQSRSEGEDS

SEQ ID NO: 253356 - protein, 24 aa, Homo sapiens
  Native (MAGC1_HUMAN)
SPESDDTLYPLQSPQSRSEGEDSS

SEQ ID NO: 253357 - protein, 25 aa, Homo sapiens
  Native (MAGC1_HUMAN)
SPESDDTLYPLQSPQSRSEGEDSSD

SEQ ID NO: 253358 - protein, 15 aa, Homo sapiens
  Native (MAGC1_HUMAN)
SPESPLQSPVISFSS

SEQ ID NO: 253359 - protein, 16 aa, Homo sapiens
  Native (MAGC1_HUMAN)
SPESPLQSPVISFSSS

SEQ ID NO: 253360 - protein, 17 aa, Homo sapiens
  Native (MAGC1_HUMAN)
SPESPLQSPVISFSSST

SEQ ID NO: 253361 - protein, 19 aa, Homo sapiens
  Native (MAGC1_HUMAN)
SPESPLQSPVISFSSSTSL

SEQ ID NO: 253362 - protein, 20 aa, Homo sapiens
  Native (MAGC1_HUMAN)
SPESPLQSPVISFSSSTSLS

SEQ ID NO: 253363 - protein, 21 aa, Homo sapiens
  Native (MAGC1_HUMAN)
SPESPLQSPVISFSSSTSLSP

SEQ ID NO: 253364 - protein, 22 aa, Homo sapiens
  Native (MAGC1_HUMAN)
SPESPLQSPVISFSSSTSLSPF

SEQ ID NO: 253365 - protein, 23 aa, Homo sapiens
  Native (MAGC1_HUMAN)
SPESPLQSPVISFSSSTSLSPFS

SEQ ID NO: 253366 - protein, 24 aa, Homo sapiens
  Native (MAGC1_HUMAN)
SPESPLQSPVISFSSSTSLSPFSE

SEQ ID NO: 253367 - protein, 25 aa, Homo sapiens
  Native (MAGC1_HUMAN)
SPESPLQSPVISFSSSTSLSPFSEE

SEQ ID NO: 253368 - protein, 19 aa, Homo sapiens
  Native (MAGC1_HUMAN)
SPESTQSPFEGFPQSPLQI

SEQ ID NO: 253369 - protein, 20 aa, Homo sapiens
  Native (MAGC1_HUMAN)
SPESTQSPFEGFPQSPLQIP

SEQ ID NO: 253370 - protein, 21 aa, Homo sapiens
  Native (MAGC1_HUMAN)
SPESTQSPFEGFPQSPLQIPV

SEQ ID NO: 253371 - protein, 22 aa, Homo sapiens
  Native (MAGC1_HUMAN)
SPESTQSPFEGFPQSPLQIPVS

SEQ ID NO: 253372 - protein, 23 aa, Homo sapiens
  Native (MAGC1_HUMAN)
SPESTQSPFEGFPQSPLQIPVSR

SEQ ID NO: 253373 - protein, 24 aa, Homo sapiens
  Native (MAGC1_HUMAN)
SPESTQSPFEGFPQSPLQIPVSRS

SEQ ID NO: 253374 - protein, 25 aa, Homo sapiens
  Native (MAGC1_HUMAN)
SPESTQSPFEGFPQSPLQIPVSRSF

SEQ ID NO: 253375 - protein, 16 aa, Homo sapiens
  Native (MAGC1_HUMAN)
SPESTQSPFEGFPQSV

SEQ ID NO: 253376 - protein, 17 aa, Homo sapiens
  Native (MAGC1_HUMAN)
SPESTQSPFEGFPQSVL

SEQ ID NO: 253377 - protein, 19 aa, Homo sapiens
  Native (MAGC1_HUMAN)
SPESTQSPFEGFPQSVLQI

SEQ ID NO: 253378 - protein, 20 aa, Homo sapiens
  Native (MAGC1_HUMAN)
SPESTQSPFEGFPQSVLQIP

SEQ ID NO: 253379 - protein, 21 aa, Homo sapiens
  Native (MAGC1_HUMAN)
SPESTQSPFEGFPQSVLQIPV

SEQ ID NO: 253380 - protein, 22 aa, Homo sapiens
  Native (MAGC1_HUMAN)
SPESTQSPFEGFPQSVLQIPVS

SEQ ID NO: 253381 - protein, 23 aa, Homo sapiens
  Native (MAGC1_HUMAN)
SPESTQSPFEGFPQSVLQIPVSA

SEQ ID NO: 253382 - protein, 24 aa, Homo sapiens
  Native (MAGC1_HUMAN)
SPESTQSPFEGFPQSVLQIPVSAA

SEQ ID NO: 253383 - protein, 25 aa, Homo sapiens
  Native (MAGC1_HUMAN)
SPESTQSPFEGFPQSVLQIPVSAAS

SEQ ID NO: 253384 - protein, 15 aa, Homo sapiens
  Native (MAGC1_HUMAN)
SPFEGFPQSPLQIPV

SEQ ID NO: 253385 - protein, 16 aa, Homo sapiens
  Native (MAGC1_HUMAN)
SPFEGFPQSPLQIPVS

SEQ ID NO: 253386 - protein, 17 aa, Homo sapiens
  Native (MAGC1_HUMAN)
SPFEGFPQSPLQIPVSR

SEQ ID NO: 253387 - protein, 19 aa, Homo sapiens
  Native (MAGC1_HUMAN)
SPFEGFPQSPLQIPVSRSF

SEQ ID NO: 253388 - protein, 20 aa, Homo sapiens
  Native (MAGC1_HUMAN)
SPFEGFPQSPLQIPVSRSFS

SEQ ID NO: 253389 - protein, 21 aa, Homo sapiens
  Native (MAGC1_HUMAN)
SPFEGFPQSPLQIPVSRSFSS

SEQ ID NO: 253390 - protein, 22 aa, Homo sapiens
  Native (MAGC1_HUMAN)
SPFEGFPQSPLQIPVSRSFSST

SEQ ID NO: 253391 - protein, 23 aa, Homo sapiens
  Native (MAGC1_HUMAN)
SPFEGFPQSPLQIPVSRSFSSTL

SEQ ID NO: 253392 - protein, 24 aa, Homo sapiens
  Native (MAGC1_HUMAN)
SPFEGFPQSPLQIPVSRSFSSTLL

SEQ ID NO: 253393 - protein, 25 aa, Homo sapiens
  Native (MAGC1_HUMAN)
SPFEGFPQSPLQIPVSRSFSSTLLS

SEQ ID NO: 253394 - protein, 14 aa, Homo sapiens
  Native (MAGC1_HUMAN)
SPFEGFPQSVLQIP

SEQ ID NO: 253395 - protein, 15 aa, Homo sapiens
  Native (MAGC1_HUMAN)
SPFEGFPQSVLQIPV

SEQ ID NO: 253396 - protein, 16 aa, Homo sapiens
  Native (MAGC1_HUMAN)
SPFEGFPQSVLQIPVS

SEQ ID NO: 253397 - protein, 17 aa, Homo sapiens
  Native (MAGC1_HUMAN)
SPFEGFPQSVLQIPVSA

SEQ ID NO: 253398 - protein, 18 aa, Homo sapiens
  Native (MAGC1_HUMAN)
SPFEGFPQSVLQIPVSAA

SEQ ID NO: 253399 - protein, 19 aa, Homo sapiens
  Native (MAGC1_HUMAN)
SPFEGFPQSVLQIPVSAAS

SEQ ID NO: 253400 - protein, 20 aa, Homo sapiens
  Native (MAGC1_HUMAN)
SPFEGFPQSVLQIPVSAASS

SEQ ID NO: 253401 - protein, 21 aa, Homo sapiens
  Native (MAGC1_HUMAN)
SPFEGFPQSVLQIPVSAASSS

SEQ ID NO: 253402 - protein, 22 aa, Homo sapiens
  Native (MAGC1_HUMAN)
SPFEGFPQSVLQIPVSAASSST

SEQ ID NO: 253403 - protein, 23 aa, Homo sapiens
  Native (MAGC1_HUMAN)
SPFEGFPQSVLQIPVSAASSSTL

SEQ ID NO: 253404 - protein, 24 aa, Homo sapiens
  Native (MAGC1_HUMAN)
SPFEGFPQSVLQIPVSAASSSTLV

SEQ ID NO: 253405 - protein, 25 aa, Homo sapiens
  Native (MAGC1_HUMAN)
SPFEGFPQSVLQIPVSAASSSTLVS

SEQ ID NO: 253406 - protein, 15 aa, Homo sapiens
  Native (MAGC1_HUMAN)
SPFSEESSSPVDEYT

SEQ ID NO: 253407 - protein, 25 aa, Homo sapiens
  Native (MAGC1_HUMAN)
SPFSEESSSPVDEYTSSSDTLLESD

SEQ ID NO: 253408 - protein, 15 aa, Homo sapiens
  Native (MAGC1_HUMAN)
SPHYFPQSPPQGEDS

SEQ ID NO: 253409 - protein, 15 aa, Homo sapiens
  Native (MAGC1_HUMAN)
SPLEGEDSLSSLHFP

SEQ ID NO: 253410 - protein, 17 aa, Homo sapiens
  Native (MAGC1_HUMAN)
SPLEGEDSLSSLHFPQS

SEQ ID NO: 253411 - protein, 19 aa, Homo sapiens
  Native (MAGC1_HUMAN)
SPLEGEDSLSSLHFPQSPP

SEQ ID NO: 253412 - protein, 20 aa, Homo sapiens
  Native (MAGC1_HUMAN)
SPLEGEDSLSSLHFPQSPPE

SEQ ID NO: 253413 - protein, 21 aa, Homo sapiens
  Native (MAGC1_HUMAN)
SPLEGEDSLSSLHFPQSPPEW

SEQ ID NO: 253414 - protein, 22 aa, Homo sapiens
  Native (MAGC1_HUMAN)
SPLEGEDSLSSLHFPQSPPEWE

SEQ ID NO: 253415 - protein, 23 aa, Homo sapiens
  Native (MAGC1_HUMAN)
SPLEGEDSLSSLHFPQSPPEWED

SEQ ID NO: 253416 - protein, 24 aa, Homo sapiens
  Native (MAGC1_HUMAN)
SPLEGEDSLSSLHFPQSPPEWEDS

SEQ ID NO: 253417 - protein, 25 aa, Homo sapiens
  Native (MAGC1_HUMAN)
SPLEGEDSLSSLHFPQSPPEWEDSL

SEQ ID NO: 253418 - protein, 23 aa, Homo sapiens
  Native (MAGC1_HUMAN)
SPLHFPQFPPQGEDFQSSLQSPV

SEQ ID NO: 253419 - protein, 24 aa, Homo sapiens
  Native (MAGC1_HUMAN)
SPLHFPQFPPQGEDFQSSLQSPVS

SEQ ID NO: 253420 - protein, 25 aa, Homo sapiens
  Native (MAGC1_HUMAN)
SPLHFPQFPPQGEDFQSSLQSPVSI

SEQ ID NO: 253421 - protein, 13 aa, Homo sapiens
  Native (MAGC1_HUMAN)
SPLQGEEFQSSLQ

SEQ ID NO: 253422 - protein, 14 aa, Homo sapiens
  Native (MAGC1_HUMAN)
SPLQGEEFQSSLQS

SEQ ID NO: 253423 - protein, 15 aa, Homo sapiens
  Native (MAGC1_HUMAN)
SPLQGEEFQSSLQSP

SEQ ID NO: 253424 - protein, 16 aa, Homo sapiens
  Native (MAGC1_HUMAN)
SPLQGEEFQSSLQSPV

SEQ ID NO: 253425 - protein, 17 aa, Homo sapiens
  Native (MAGC1_HUMAN)
SPLQGEEFQSSLQSPVS

SEQ ID NO: 253426 - protein, 18 aa, Homo sapiens
  Native (MAGC1_HUMAN)
SPLQGEEFQSSLQSPVSI

SEQ ID NO: 253427 - protein, 19 aa, Homo sapiens
  Native (MAGC1_HUMAN)
SPLQGEEFQSSLQSPVSIC

SEQ ID NO: 253428 - protein, 20 aa, Homo sapiens
  Native (MAGC1_HUMAN)
SPLQGEEFQSSLQSPVSICS

SEQ ID NO: 253429 - protein, 21 aa, Homo sapiens
  Native (MAGC1_HUMAN)
SPLQGEEFQSSLQSPVSICSS

SEQ ID NO: 253430 - protein, 22 aa, Homo sapiens
  Native (MAGC1_HUMAN)
SPLQGEEFQSSLQSPVSICSSS

SEQ ID NO: 253431 - protein, 23 aa, Homo sapiens
  Native (MAGC1_HUMAN)
SPLQGEEFQSSLQSPVSICSSST

SEQ ID NO: 253432 - protein, 24 aa, Homo sapiens
  Native (MAGC1_HUMAN)
SPLQGEEFQSSLQSPVSICSSSTP

SEQ ID NO: 253433 - protein, 25 aa, Homo sapiens
  Native (MAGC1_HUMAN)
SPLQGEEFQSSLQSPVSICSSSTPS

SEQ ID NO: 253434 - protein, 14 aa, Homo sapiens
  Native (MAGC1_HUMAN)
SPLQIPGSPSFSST

SEQ ID NO: 253435 - protein, 15 aa, Homo sapiens
  Native (MAGC1_HUMAN)
SPLQIPGSPSFSSTL

SEQ ID NO: 253436 - protein, 16 aa, Homo sapiens
  Native (MAGC1_HUMAN)
SPLQIPGSPSFSSTLL

SEQ ID NO: 253437 - protein, 17 aa, Homo sapiens
  Native (MAGC1_HUMAN)
SPLQIPGSPSFSSTLLS

SEQ ID NO: 253438 - protein, 18 aa, Homo sapiens
  Native (MAGC1_HUMAN)
SPLQIPGSPSFSSTLLSL

SEQ ID NO: 253439 - protein, 19 aa, Homo sapiens
  Native (MAGC1_HUMAN)
SPLQIPGSPSFSSTLLSLF

SEQ ID NO: 253440 - protein, 20 aa, Homo sapiens
  Native (MAGC1_HUMAN)
SPLQIPGSPSFSSTLLSLFQ

SEQ ID NO: 253441 - protein, 21 aa, Homo sapiens
  Native (MAGC1_HUMAN)
SPLQIPGSPSFSSTLLSLFQS

SEQ ID NO: 253442 - protein, 22 aa, Homo sapiens
  Native (MAGC1_HUMAN)
SPLQIPGSPSFSSTLLSLFQSS

SEQ ID NO: 253443 - protein, 23 aa, Homo sapiens
  Native (MAGC1_HUMAN)
SPLQIPGSPSFSSTLLSLFQSSP

SEQ ID NO: 253444 - protein, 24 aa, Homo sapiens
  Native (MAGC1_HUMAN)
SPLQIPGSPSFSSTLLSLFQSSPE

SEQ ID NO: 253445 - protein, 25 aa, Homo sapiens
  Native (MAGC1_HUMAN)
SPLQIPGSPSFSSTLLSLFQSSPER

SEQ ID NO: 253446 - protein, 14 aa, Homo sapiens
  Native (MAGC1_HUMAN)
SPLQIPMTSSFSST

SEQ ID NO: 253447 - protein, 15 aa, Homo sapiens
  Native (MAGC1_HUMAN)
SPLQIPMTSSFSSTL

SEQ ID NO: 253448 - protein, 16 aa, Homo sapiens
  Native (MAGC1_HUMAN)
SPLQIPMTSSFSSTLL

SEQ ID NO: 253449 - protein, 17 aa, Homo sapiens
  Native (MAGC1_HUMAN)
SPLQIPMTSSFSSTLLS

SEQ ID NO: 253450 - protein, 18 aa, Homo sapiens
  Native (MAGC1_HUMAN)
SPLQIPMTSSFSSTLLSI

SEQ ID NO: 253451 - protein, 19 aa, Homo sapiens
  Native (MAGC1_HUMAN)
SPLQIPMTSSFSSTLLSIL

SEQ ID NO: 253452 - protein, 20 aa, Homo sapiens
  Native (MAGC1_HUMAN)
SPLQIPMTSSFSSTLLSILQ

SEQ ID NO: 253453 - protein, 21 aa, Homo sapiens
  Native (MAGC1_HUMAN)
SPLQIPMTSSFSSTLLSILQS

SEQ ID NO: 253454 - protein, 22 aa, Homo sapiens
  Native (MAGC1_HUMAN)
SPLQIPMTSSFSSTLLSILQSS

SEQ ID NO: 253455 - protein, 23 aa, Homo sapiens
  Native (MAGC1_HUMAN)
SPLQIPMTSSFSSTLLSILQSSP

SEQ ID NO: 253456 - protein, 24 aa, Homo sapiens
  Native (MAGC1_HUMAN)
SPLQIPMTSSFSSTLLSILQSSPE

SEQ ID NO: 253457 - protein, 25 aa, Homo sapiens
  Native (MAGC1_HUMAN)
SPLQIPMTSSFSSTLLSILQSSPES

SEQ ID NO: 253458 - protein, 25 aa, Homo sapiens
  Native (MAGC1_HUMAN)
SPLQIPQSPLEGEDSLSSLHFPQSP

SEQ ID NO: 253459 - protein, 25 aa, Homo sapiens
  Native (MAGC1_HUMAN)
SPLQIPQSPPEGENTHSPLQIVPSL

SEQ ID NO: 253460 - protein, 25 aa, Homo sapiens
  Native (MAGC1_HUMAN)
SPLQIPQSSPESDDTLYPLQSPQSR

SEQ ID NO: 253461 - protein, 15 aa, Homo sapiens
  Native (MAGC1_HUMAN)
SPLQIPVSPSSSSTL

SEQ ID NO: 253462 - protein, 16 aa, Homo sapiens
  Native (MAGC1_HUMAN)
SPLQIPVSPSSSSTLL

SEQ ID NO: 253463 - protein, 17 aa, Homo sapiens
  Native (MAGC1_HUMAN)
SPLQIPVSPSSSSTLLS

SEQ ID NO: 253464 - protein, 18 aa, Homo sapiens
  Native (MAGC1_HUMAN)
SPLQIPVSPSSSSTLLSL

SEQ ID NO: 253465 - protein, 19 aa, Homo sapiens
  Native (MAGC1_HUMAN)
SPLQIPVSPSSSSTLLSLF

SEQ ID NO: 253466 - protein, 20 aa, Homo sapiens
  Native (MAGC1_HUMAN)
SPLQIPVSPSSSSTLLSLFQ

SEQ ID NO: 253467 - protein, 21 aa, Homo sapiens
  Native (MAGC1_HUMAN)
SPLQIPVSPSSSSTLLSLFQS

SEQ ID NO: 253468 - protein, 22 aa, Homo sapiens
  Native (MAGC1_HUMAN)
SPLQIPVSPSSSSTLLSLFQSF

SEQ ID NO: 253469 - protein, 23 aa, Homo sapiens
  Native (MAGC1_HUMAN)
SPLQIPVSPSSSSTLLSLFQSFS

SEQ ID NO: 253470 - protein, 24 aa, Homo sapiens
  Native (MAGC1_HUMAN)
SPLQIPVSPSSSSTLLSLFQSFSE

SEQ ID NO: 253471 - protein, 25 aa, Homo sapiens
  Native (MAGC1_HUMAN)
SPLQIPVSPSSSSTLLSLFQSFSER

SEQ ID NO: 253472 - protein, 15 aa, Homo sapiens
  Native (MAGC1_HUMAN)
SPLQIPVSRSFSSTL

SEQ ID NO: 253473 - protein, 16 aa, Homo sapiens
  Native (MAGC1_HUMAN)
SPLQIPVSRSFSSTLL

SEQ ID NO: 253474 - protein, 17 aa, Homo sapiens
  Native (MAGC1_HUMAN)
SPLQIPVSRSFSSTLLS

SEQ ID NO: 253475 - protein, 18 aa, Homo sapiens
  Native (MAGC1_HUMAN)
SPLQIPVSRSFSSTLLSI

SEQ ID NO: 253476 - protein, 19 aa, Homo sapiens
  Native (MAGC1_HUMAN)
SPLQIPVSRSFSSTLLSIF

SEQ ID NO: 253477 - protein, 20 aa, Homo sapiens
  Native (MAGC1_HUMAN)
SPLQIPVSRSFSSTLLSIFQ

SEQ ID NO: 253478 - protein, 21 aa, Homo sapiens
  Native (MAGC1_HUMAN)
SPLQIPVSRSFSSTLLSIFQS

SEQ ID NO: 253479 - protein, 22 aa, Homo sapiens
  Native (MAGC1_HUMAN)
SPLQIPVSRSFSSTLLSIFQSS

SEQ ID NO: 253480 - protein, 23 aa, Homo sapiens
  Native (MAGC1_HUMAN)
SPLQIPVSRSFSSTLLSIFQSSP

SEQ ID NO: 253481 - protein, 24 aa, Homo sapiens
  Native (MAGC1_HUMAN)
SPLQIPVSRSFSSTLLSIFQSSPE

SEQ ID NO: 253482 - protein, 25 aa, Homo sapiens
  Native (MAGC1_HUMAN)
SPLQIPVSRSFSSTLLSIFQSSPER

SEQ ID NO: 253483 - protein, 15 aa, Homo sapiens
  Native (MAGC1_HUMAN)
SPLQIPVSSSFSYTL

SEQ ID NO: 253484 - protein, 16 aa, Homo sapiens
  Native (MAGC1_HUMAN)
SPLQIPVSSSFSYTLL

SEQ ID NO: 253485 - protein, 17 aa, Homo sapiens
  Native (MAGC1_HUMAN)
SPLQIPVSSSFSYTLLS

SEQ ID NO: 253486 - protein, 18 aa, Homo sapiens
  Native (MAGC1_HUMAN)
SPLQIPVSSSFSYTLLSL

SEQ ID NO: 253487 - protein, 19 aa, Homo sapiens
  Native (MAGC1_HUMAN)
SPLQIPVSSSFSYTLLSLF

SEQ ID NO: 253488 - protein, 20 aa, Homo sapiens
  Native (MAGC1_HUMAN)
SPLQIPVSSSFSYTLLSLFQ

SEQ ID NO: 253489 - protein, 21 aa, Homo sapiens
  Native (MAGC1_HUMAN)
SPLQIPVSSSFSYTLLSLFQS

SEQ ID NO: 253490 - protein, 22 aa, Homo sapiens
  Native (MAGC1_HUMAN)
SPLQIPVSSSFSYTLLSLFQSS

SEQ ID NO: 253491 - protein, 23 aa, Homo sapiens
  Native (MAGC1_HUMAN)
SPLQIPVSSSFSYTLLSLFQSSP

SEQ ID NO: 253492 - protein, 24 aa, Homo sapiens
  Native (MAGC1_HUMAN)
SPLQIPVSSSFSYTLLSLFQSSPE

SEQ ID NO: 253493 - protein, 25 aa, Homo sapiens
  Native (MAGC1_HUMAN)
SPLQIPVSSSFSYTLLSLFQSSPER

SEQ ID NO: 253494 - protein, 14 aa, Homo sapiens
  Native (MAGC1_HUMAN)
SPLQIPVSSSSSSS

SEQ ID NO: 253495 - protein, 15 aa, Homo sapiens
  Native (MAGC1_HUMAN)
SPLQIPVSSSSSSST

SEQ ID NO: 253496 - protein, 16 aa, Homo sapiens
  Native (MAGC1_HUMAN)
SPLQIPVSSSSSSSTL

SEQ ID NO: 253497 - protein, 17 aa, Homo sapiens
  Native (MAGC1_HUMAN)
SPLQIPVSSSSSSSTLL

SEQ ID NO: 253498 - protein, 18 aa, Homo sapiens
  Native (MAGC1_HUMAN)
SPLQIPVSSSSSSSTLLS

SEQ ID NO: 253499 - protein, 19 aa, Homo sapiens
  Native (MAGC1_HUMAN)
SPLQIPVSSSSSSSTLLSL

SEQ ID NO: 253500 - protein, 20 aa, Homo sapiens
  Native (MAGC1_HUMAN)
SPLQIPVSSSSSSSTLLSLF

SEQ ID NO: 253501 - protein, 21 aa, Homo sapiens
  Native (MAGC1_HUMAN)
SPLQIPVSSSSSSSTLLSLFQ

SEQ ID NO: 253502 - protein, 22 aa, Homo sapiens
  Native (MAGC1_HUMAN)
SPLQIPVSSSSSSSTLLSLFQS

SEQ ID NO: 253503 - protein, 23 aa, Homo sapiens
  Native (MAGC1_HUMAN)
SPLQIPVSSSSSSSTLLSLFQSS

SEQ ID NO: 253504 - protein, 24 aa, Homo sapiens
  Native (MAGC1_HUMAN)
SPLQIPVSSSSSSSTLLSLFQSSP

SEQ ID NO: 253505 - protein, 25 aa, Homo sapiens
  Native (MAGC1_HUMAN)
SPLQIPVSSSSSSSTLLSLFQSSPE

SEQ ID NO: 253506 - protein, 14 aa, Homo sapiens
  Native (MAGC1_HUMAN)
SPLQIPVSSSSSST

SEQ ID NO: 253507 - protein, 15 aa, Homo sapiens
  Native (MAGC1_HUMAN)
SPLQIPVSSSSSSTL

SEQ ID NO: 253508 - protein, 16 aa, Homo sapiens
  Native (MAGC1_HUMAN)
SPLQIPVSSSSSSTLL

SEQ ID NO: 253509 - protein, 17 aa, Homo sapiens
  Native (MAGC1_HUMAN)
SPLQIPVSSSSSSTLLS

SEQ ID NO: 253510 - protein, 18 aa, Homo sapiens
  Native (MAGC1_HUMAN)
SPLQIPVSSSSSSTLLSL

SEQ ID NO: 253511 - protein, 19 aa, Homo sapiens
  Native (MAGC1_HUMAN)
SPLQIPVSSSSSSTLLSLF

SEQ ID NO: 253512 - protein, 20 aa, Homo sapiens
  Native (MAGC1_HUMAN)
SPLQIPVSSSSSSTLLSLFQ

SEQ ID NO: 253513 - protein, 21 aa, Homo sapiens
  Native (MAGC1_HUMAN)
SPLQIPVSSSSSSTLLSLFQS

SEQ ID NO: 253514 - protein, 22 aa, Homo sapiens
  Native (MAGC1_HUMAN)
SPLQIPVSSSSSSTLLSLFQSS

SEQ ID NO: 253515 - protein, 23 aa, Homo sapiens
  Native (MAGC1_HUMAN)
SPLQIPVSSSSSSTLLSLFQSSP

SEQ ID NO: 253516 - protein, 24 aa, Homo sapiens
  Native (MAGC1_HUMAN)
SPLQIPVSSSSSSTLLSLFQSSPE

SEQ ID NO: 253517 - protein, 25 aa, Homo sapiens
  Native (MAGC1_HUMAN)
SPLQIPVSSSSSSTLLSLFQSSPER

SEQ ID NO: 253518 - protein, 13 aa, Homo sapiens
  Native (MAGC1_HUMAN)
SPLQIVPSLPEWE

SEQ ID NO: 253519 - protein, 14 aa, Homo sapiens
  Native (MAGC1_HUMAN)
SPLQIVPSLPEWED

SEQ ID NO: 253520 - protein, 15 aa, Homo sapiens
  Native (MAGC1_HUMAN)
SPLQIVPSLPEWEDS

SEQ ID NO: 253521 - protein, 16 aa, Homo sapiens
  Native (MAGC1_HUMAN)
SPLQIVPSLPEWEDSL

SEQ ID NO: 253522 - protein, 17 aa, Homo sapiens
  Native (MAGC1_HUMAN)
SPLQIVPSLPEWEDSLS

SEQ ID NO: 253523 - protein, 18 aa, Homo sapiens
  Native (MAGC1_HUMAN)
SPLQIVPSLPEWEDSLSP

SEQ ID NO: 253524 - protein, 19 aa, Homo sapiens
  Native (MAGC1_HUMAN)
SPLQIVPSLPEWEDSLSPH

SEQ ID NO: 253525 - protein, 20 aa, Homo sapiens
  Native (MAGC1_HUMAN)
SPLQIVPSLPEWEDSLSPHY

SEQ ID NO: 253526 - protein, 21 aa, Homo sapiens
  Native (MAGC1_HUMAN)
SPLQIVPSLPEWEDSLSPHYF

SEQ ID NO: 253527 - protein, 22 aa, Homo sapiens
  Native (MAGC1_HUMAN)
SPLQIVPSLPEWEDSLSPHYFP

SEQ ID NO: 253528 - protein, 23 aa, Homo sapiens
  Native (MAGC1_HUMAN)
SPLQIVPSLPEWEDSLSPHYFPQ

SEQ ID NO: 253529 - protein, 24 aa, Homo sapiens
  Native (MAGC1_HUMAN)
SPLQIVPSLPEWEDSLSPHYFPQS

SEQ ID NO: 253530 - protein, 25 aa, Homo sapiens
  Native (MAGC1_HUMAN)
SPLQIVPSLPEWEDSLSPHYFPQSP

SEQ ID NO: 253531 - protein, 14 aa, Homo sapiens
  Native (MAGC1_HUMAN)
SPLQNPASSFFSSA

SEQ ID NO: 253532 - protein, 15 aa, Homo sapiens
  Native (MAGC1_HUMAN)
SPLQNPASSFFSSAL

SEQ ID NO: 253533 - protein, 16 aa, Homo sapiens
  Native (MAGC1_HUMAN)
SPLQNPASSFFSSALL

SEQ ID NO: 253534 - protein, 17 aa, Homo sapiens
  Native (MAGC1_HUMAN)
SPLQNPASSFFSSALLS

SEQ ID NO: 253535 - protein, 18 aa, Homo sapiens
  Native (MAGC1_HUMAN)
SPLQNPASSFFSSALLSI

SEQ ID NO: 253536 - protein, 19 aa, Homo sapiens
  Native (MAGC1_HUMAN)
SPLQNPASSFFSSALLSIF

SEQ ID NO: 253537 - protein, 20 aa, Homo sapiens
  Native (MAGC1_HUMAN)
SPLQNPASSFFSSALLSIFQ

SEQ ID NO: 253538 - protein, 21 aa, Homo sapiens
  Native (MAGC1_HUMAN)
SPLQNPASSFFSSALLSIFQS

SEQ ID NO: 253539 - protein, 22 aa, Homo sapiens
  Native (MAGC1_HUMAN)
SPLQNPASSFFSSALLSIFQSS

SEQ ID NO: 253540 - protein, 23 aa, Homo sapiens
  Native (MAGC1_HUMAN)
SPLQNPASSFFSSALLSIFQSSP

SEQ ID NO: 253541 - protein, 24 aa, Homo sapiens
  Native (MAGC1_HUMAN)
SPLQNPASSFFSSALLSIFQSSPE

SEQ ID NO: 253542 - protein, 25 aa, Homo sapiens
  Native (MAGC1_HUMAN)
SPLQNPASSFFSSALLSIFQSSPES

SEQ ID NO: 253543 - protein, 14 aa, Homo sapiens
  Native (MAGC1_HUMAN)
SPLQRPVSSFFSYT

SEQ ID NO: 253544 - protein, 15 aa, Homo sapiens
  Native (MAGC1_HUMAN)
SPLQRPVSSFFSYTL

SEQ ID NO: 253545 - protein, 16 aa, Homo sapiens
  Native (MAGC1_HUMAN)
SPLQRPVSSFFSYTLA

SEQ ID NO: 253546 - protein, 17 aa, Homo sapiens
  Native (MAGC1_HUMAN)
SPLQRPVSSFFSYTLAS

SEQ ID NO: 253547 - protein, 18 aa, Homo sapiens
  Native (MAGC1_HUMAN)
SPLQRPVSSFFSYTLASL

SEQ ID NO: 253548 - protein, 19 aa, Homo sapiens
  Native (MAGC1_HUMAN)
SPLQRPVSSFFSYTLASLL

SEQ ID NO: 253549 - protein, 20 aa, Homo sapiens
  Native (MAGC1_HUMAN)
SPLQRPVSSFFSYTLASLLQ

SEQ ID NO: 253550 - protein, 21 aa, Homo sapiens
  Native (MAGC1_HUMAN)
SPLQRPVSSFFSYTLASLLQS

SEQ ID NO: 253551 - protein, 22 aa, Homo sapiens
  Native (MAGC1_HUMAN)
SPLQRPVSSFFSYTLASLLQSS

SEQ ID NO: 253552 - protein, 23 aa, Homo sapiens
  Native (MAGC1_HUMAN)
SPLQRPVSSFFSYTLASLLQSSH

SEQ ID NO: 253553 - protein, 24 aa, Homo sapiens
  Native (MAGC1_HUMAN)
SPLQRPVSSFFSYTLASLLQSSHE

SEQ ID NO: 253554 - protein, 25 aa, Homo sapiens
  Native (MAGC1_HUMAN)
SPLQRPVSSFFSYTLASLLQSSHES

SEQ ID NO: 253555 - protein, 14 aa, Homo sapiens
  Native (MAGC1_HUMAN)
SPLQSPVISFSSST

SEQ ID NO: 253556 - protein, 15 aa, Homo sapiens
  Native (MAGC1_HUMAN)
SPLQSPVISFSSSTS

SEQ ID NO: 253557 - protein, 16 aa, Homo sapiens
  Native (MAGC1_HUMAN)
SPLQSPVISFSSSTSL

SEQ ID NO: 253558 - protein, 17 aa, Homo sapiens
  Native (MAGC1_HUMAN)
SPLQSPVISFSSSTSLS

SEQ ID NO: 253559 - protein, 18 aa, Homo sapiens
  Native (MAGC1_HUMAN)
SPLQSPVISFSSSTSLSP

SEQ ID NO: 253560 - protein, 19 aa, Homo sapiens
  Native (MAGC1_HUMAN)
SPLQSPVISFSSSTSLSPF

SEQ ID NO: 253561 - protein, 20 aa, Homo sapiens
  Native (MAGC1_HUMAN)
SPLQSPVISFSSSTSLSPFS

SEQ ID NO: 253562 - protein, 21 aa, Homo sapiens
  Native (MAGC1_HUMAN)
SPLQSPVISFSSSTSLSPFSE

SEQ ID NO: 253563 - protein, 22 aa, Homo sapiens
  Native (MAGC1_HUMAN)
SPLQSPVISFSSSTSLSPFSEE

SEQ ID NO: 253564 - protein, 23 aa, Homo sapiens
  Native (MAGC1_HUMAN)
SPLQSPVISFSSSTSLSPFSEES

SEQ ID NO: 253565 - protein, 24 aa, Homo sapiens
  Native (MAGC1_HUMAN)
SPLQSPVISFSSSTSLSPFSEESS

SEQ ID NO: 253566 - protein, 25 aa, Homo sapiens
  Native (MAGC1_HUMAN)
SPLQSPVISFSSSTSLSPFSEESSS

SEQ ID NO: 253567 - protein, 14 aa, Homo sapiens
  Native (MAGC1_HUMAN)
SPLQSPVSSFPSST

SEQ ID NO: 253568 - protein, 15 aa, Homo sapiens
  Native (MAGC1_HUMAN)
SPLQSPVSSFPSSTS

SEQ ID NO: 253569 - protein, 16 aa, Homo sapiens
  Native (MAGC1_HUMAN)
SPLQSPVSSFPSSTSS

SEQ ID NO: 253570 - protein, 17 aa, Homo sapiens
  Native (MAGC1_HUMAN)
SPLQSPVSSFPSSTSSS

SEQ ID NO: 253571 - protein, 18 aa, Homo sapiens
  Native (MAGC1_HUMAN)
SPLQSPVSSFPSSTSSSL

SEQ ID NO: 253572 - protein, 19 aa, Homo sapiens
  Native (MAGC1_HUMAN)
SPLQSPVSSFPSSTSSSLS

SEQ ID NO: 253573 - protein, 20 aa, Homo sapiens
  Native (MAGC1_HUMAN)
SPLQSPVSSFPSSTSSSLSQ

SEQ ID NO: 253574 - protein, 21 aa, Homo sapiens
  Native (MAGC1_HUMAN)
SPLQSPVSSFPSSTSSSLSQS

SEQ ID NO: 253575 - protein, 22 aa, Homo sapiens
  Native (MAGC1_HUMAN)
SPLQSPVSSFPSSTSSSLSQSS

SEQ ID NO: 253576 - protein, 23 aa, Homo sapiens
  Native (MAGC1_HUMAN)
SPLQSPVSSFPSSTSSSLSQSSP

SEQ ID NO: 253577 - protein, 24 aa, Homo sapiens
  Native (MAGC1_HUMAN)
SPLQSPVSSFPSSTSSSLSQSSPV

SEQ ID NO: 253578 - protein, 25 aa, Homo sapiens
  Native (MAGC1_HUMAN)
SPLQSPVSSFPSSTSSSLSQSSPVS

SEQ ID NO: 253579 - protein, 13 aa, Homo sapiens
  Native (MAGC1_HUMAN)
SPLYFPQSPLQGE

SEQ ID NO: 253580 - protein, 14 aa, Homo sapiens
  Native (MAGC1_HUMAN)
SPLYFPQSPLQGEE

SEQ ID NO: 253581 - protein, 16 aa, Homo sapiens
  Native (MAGC1_HUMAN)
SPLYFPQSPLQGEEFQ

SEQ ID NO: 253582 - protein, 17 aa, Homo sapiens
  Native (MAGC1_HUMAN)
SPLYFPQSPLQGEEFQS

SEQ ID NO: 253583 - protein, 18 aa, Homo sapiens
  Native (MAGC1_HUMAN)
SPLYFPQSPLQGEEFQSS

SEQ ID NO: 253584 - protein, 19 aa, Homo sapiens
  Native (MAGC1_HUMAN)
SPLYFPQSPLQGEEFQSSL

SEQ ID NO: 253585 - protein, 20 aa, Homo sapiens
  Native (MAGC1_HUMAN)
SPLYFPQSPLQGEEFQSSLQ

SEQ ID NO: 253586 - protein, 21 aa, Homo sapiens
  Native (MAGC1_HUMAN)
SPLYFPQSPLQGEEFQSSLQS

SEQ ID NO: 253587 - protein, 22 aa, Homo sapiens
  Native (MAGC1_HUMAN)
SPLYFPQSPLQGEEFQSSLQSP

SEQ ID NO: 253588 - protein, 23 aa, Homo sapiens
  Native (MAGC1_HUMAN)
SPLYFPQSPLQGEEFQSSLQSPV

SEQ ID NO: 253589 - protein, 24 aa, Homo sapiens
  Native (MAGC1_HUMAN)
SPLYFPQSPLQGEEFQSSLQSPVS

SEQ ID NO: 253590 - protein, 25 aa, Homo sapiens
  Native (MAGC1_HUMAN)
SPLYFPQSPLQGEEFQSSLQSPVSI

SEQ ID NO: 253591 - protein, 24 aa, Homo sapiens
  Native (MAGC1_HUMAN)
SPPEGEDVQSPLQNPASSFFSSAL

SEQ ID NO: 253592 - protein, 25 aa, Homo sapiens
  Native (MAGC1_HUMAN)
SPPEGEDVQSPLQNPASSFFSSALL

SEQ ID NO: 253593 - protein, 17 aa, Homo sapiens
  Native (MAGC1_HUMAN)
SPPEGENTHSPLQIVPS

SEQ ID NO: 253594 - protein, 19 aa, Homo sapiens
  Native (MAGC1_HUMAN)
SPPEGENTHSPLQIVPSLP

SEQ ID NO: 253595 - protein, 20 aa, Homo sapiens
  Native (MAGC1_HUMAN)
SPPEGENTHSPLQIVPSLPE

SEQ ID NO: 253596 - protein, 21 aa, Homo sapiens
  Native (MAGC1_HUMAN)
SPPEGENTHSPLQIVPSLPEW

SEQ ID NO: 253597 - protein, 22 aa, Homo sapiens
  Native (MAGC1_HUMAN)
SPPEGENTHSPLQIVPSLPEWE

SEQ ID NO: 253598 - protein, 23 aa, Homo sapiens
  Native (MAGC1_HUMAN)
SPPEGENTHSPLQIVPSLPEWED

SEQ ID NO: 253599 - protein, 24 aa, Homo sapiens
  Native (MAGC1_HUMAN)
SPPEGENTHSPLQIVPSLPEWEDS

SEQ ID NO: 253600 - protein, 25 aa, Homo sapiens
  Native (MAGC1_HUMAN)
SPPEGENTHSPLQIVPSLPEWEDSL

SEQ ID NO: 253601 - protein, 15 aa, Homo sapiens
  Native (MAGC1_HUMAN)
SPPEGMHSQSPLQSP

SEQ ID NO: 253602 - protein, 20 aa, Homo sapiens
  Native (MAGC1_HUMAN)
SPPEGMHSQSPLQSPESAPE

SEQ ID NO: 253603 - protein, 23 aa, Homo sapiens
  Native (MAGC1_HUMAN)
SPPEGPAQSPLQRPVSSFFSYTL

SEQ ID NO: 253604 - protein, 24 aa, Homo sapiens
  Native (MAGC1_HUMAN)
SPPEGPAQSPLQRPVSSFFSYTLA

SEQ ID NO: 253605 - protein, 25 aa, Homo sapiens
  Native (MAGC1_HUMAN)
SPPEGPAQSPLQRPVSSFFSYTLAS

SEQ ID NO: 253606 - protein, 23 aa, Homo sapiens
  Native (MAGC1_HUMAN)
SPPEGPAQSPLQSPVSSFPSSTS

SEQ ID NO: 253607 - protein, 24 aa, Homo sapiens
  Native (MAGC1_HUMAN)
SPPEGPAQSPLQSPVSSFPSSTSS

SEQ ID NO: 253608 - protein, 25 aa, Homo sapiens
  Native (MAGC1_HUMAN)
SPPEGPAQSPLQSPVSSFPSSTSSS

SEQ ID NO: 253609 - protein, 19 aa, Homo sapiens
  Native (MAGC1_HUMAN)
SPPEWEDSLSPLHFPQFPP

SEQ ID NO: 253610 - protein, 20 aa, Homo sapiens
  Native (MAGC1_HUMAN)
SPPEWEDSLSPLHFPQFPPQ

SEQ ID NO: 253611 - protein, 21 aa, Homo sapiens
  Native (MAGC1_HUMAN)
SPPEWEDSLSPLHFPQFPPQG

SEQ ID NO: 253612 - protein, 22 aa, Homo sapiens
  Native (MAGC1_HUMAN)
SPPEWEDSLSPLHFPQFPPQGE

SEQ ID NO: 253613 - protein, 23 aa, Homo sapiens
  Native (MAGC1_HUMAN)
SPPEWEDSLSPLHFPQFPPQGED

SEQ ID NO: 253614 - protein, 24 aa, Homo sapiens
  Native (MAGC1_HUMAN)
SPPEWEDSLSPLHFPQFPPQGEDF

SEQ ID NO: 253615 - protein, 25 aa, Homo sapiens
  Native (MAGC1_HUMAN)
SPPEWEDSLSPLHFPQFPPQGEDFQ

SEQ ID NO: 253616 - protein, 20 aa, Homo sapiens
  Native (MAGC1_HUMAN)
SPPQGEDSMSPLYFPQSPLQ

SEQ ID NO: 253617 - protein, 21 aa, Homo sapiens
  Native (MAGC1_HUMAN)
SPPQGEDSMSPLYFPQSPLQG

SEQ ID NO: 253618 - protein, 22 aa, Homo sapiens
  Native (MAGC1_HUMAN)
SPPQGEDSMSPLYFPQSPLQGE

SEQ ID NO: 253619 - protein, 23 aa, Homo sapiens
  Native (MAGC1_HUMAN)
SPPQGEDSMSPLYFPQSPLQGEE

SEQ ID NO: 253620 - protein, 24 aa, Homo sapiens
  Native (MAGC1_HUMAN)
SPPQGEDSMSPLYFPQSPLQGEEF

SEQ ID NO: 253621 - protein, 25 aa, Homo sapiens
  Native (MAGC1_HUMAN)
SPPQGEDSMSPLYFPQSPLQGEEFQ

SEQ ID NO: 253622 - protein, 13 aa, Homo sapiens
  Native (MAGC1_HUMAN)
SPPRYEFLWGPRA

SEQ ID NO: 253623 - protein, 14 aa, Homo sapiens
  Native (MAGC1_HUMAN)
SPPRYEFLWGPRAH

SEQ ID NO: 253624 - protein, 15 aa, Homo sapiens
  Native (MAGC1_HUMAN)
SPPRYEFLWGPRAHS

SEQ ID NO: 253625 - protein, 16 aa, Homo sapiens
  Native (MAGC1_HUMAN)
SPPRYEFLWGPRAHSE

SEQ ID NO: 253626 - protein, 17 aa, Homo sapiens
  Native (MAGC1_HUMAN)
SPPRYEFLWGPRAHSEV

SEQ ID NO: 253627 - protein, 18 aa, Homo sapiens
  Native (MAGC1_HUMAN)
SPPRYEFLWGPRAHSEVI

SEQ ID NO: 253628 - protein, 19 aa, Homo sapiens
  Native (MAGC1_HUMAN)
SPPRYEFLWGPRAHSEVIK

SEQ ID NO: 253629 - protein, 20 aa, Homo sapiens
  Native (MAGC1_HUMAN)
SPPRYEFLWGPRAHSEVIKR

SEQ ID NO: 253630 - protein, 21 aa, Homo sapiens
  Native (MAGC1_HUMAN)
SPPRYEFLWGPRAHSEVIKRK

SEQ ID NO: 253631 - protein, 22 aa, Homo sapiens
  Native (MAGC1_HUMAN)
SPPRYEFLWGPRAHSEVIKRKV

SEQ ID NO: 253632 - protein, 23 aa, Homo sapiens
  Native (MAGC1_HUMAN)
SPPRYEFLWGPRAHSEVIKRKVV

SEQ ID NO: 253633 - protein, 24 aa, Homo sapiens
  Native (MAGC1_HUMAN)
SPPRYEFLWGPRAHSEVIKRKVVE

SEQ ID NO: 253634 - protein, 25 aa, Homo sapiens
  Native (MAGC1_HUMAN)
SPPRYEFLWGPRAHSEVIKRKVVEF

SEQ ID NO: 253635 - protein, 20 aa, Homo sapiens
  Native (MAGC1_HUMAN)
SPQSPPEGMHSQSPLQSPES

SEQ ID NO: 253636 - protein, 13 aa, Homo sapiens
  Native (MAGC1_HUMAN)
SPSFSSTLLSLFQ

SEQ ID NO: 253637 - protein, 14 aa, Homo sapiens
  Native (MAGC1_HUMAN)
SPSFSSTLLSLFQS

SEQ ID NO: 253638 - protein, 15 aa, Homo sapiens
  Native (MAGC1_HUMAN)
SPSFSSTLLSLFQSS

SEQ ID NO: 253639 - protein, 16 aa, Homo sapiens
  Native (MAGC1_HUMAN)
SPSFSSTLLSLFQSSP

SEQ ID NO: 253640 - protein, 17 aa, Homo sapiens
  Native (MAGC1_HUMAN)
SPSFSSTLLSLFQSSPE

SEQ ID NO: 253641 - protein, 18 aa, Homo sapiens
  Native (MAGC1_HUMAN)
SPSFSSTLLSLFQSSPER

SEQ ID NO: 253642 - protein, 19 aa, Homo sapiens
  Native (MAGC1_HUMAN)
SPSFSSTLLSLFQSSPERT

SEQ ID NO: 253643 - protein, 20 aa, Homo sapiens
  Native (MAGC1_HUMAN)
SPSFSSTLLSLFQSSPERTH

SEQ ID NO: 253644 - protein, 21 aa, Homo sapiens
  Native (MAGC1_HUMAN)
SPSFSSTLLSLFQSSPERTHS

SEQ ID NO: 253645 - protein, 22 aa, Homo sapiens
  Native (MAGC1_HUMAN)
SPSFSSTLLSLFQSSPERTHST

SEQ ID NO: 253646 - protein, 23 aa, Homo sapiens
  Native (MAGC1_HUMAN)
SPSFSSTLLSLFQSSPERTHSTF

SEQ ID NO: 253647 - protein, 24 aa, Homo sapiens
  Native (MAGC1_HUMAN)
SPSFSSTLLSLFQSSPERTHSTFE

SEQ ID NO: 253648 - protein, 25 aa, Homo sapiens
  Native (MAGC1_HUMAN)
SPSFSSTLLSLFQSSPERTHSTFEG

SEQ ID NO: 253649 - protein, 13 aa, Homo sapiens
  Native (MAGC1_HUMAN)
SPSFSSTLVSLFQ

SEQ ID NO: 253650 - protein, 14 aa, Homo sapiens
  Native (MAGC1_HUMAN)
SPSFSSTLVSLFQS

SEQ ID NO: 253651 - protein, 15 aa, Homo sapiens
  Native (MAGC1_HUMAN)
SPSFSSTLVSLFQSS

SEQ ID NO: 253652 - protein, 16 aa, Homo sapiens
  Native (MAGC1_HUMAN)
SPSFSSTLVSLFQSSP

SEQ ID NO: 253653 - protein, 17 aa, Homo sapiens
  Native (MAGC1_HUMAN)
SPSFSSTLVSLFQSSPE

SEQ ID NO: 253654 - protein, 18 aa, Homo sapiens
  Native (MAGC1_HUMAN)
SPSFSSTLVSLFQSSPER

SEQ ID NO: 253655 - protein, 19 aa, Homo sapiens
  Native (MAGC1_HUMAN)
SPSFSSTLVSLFQSSPERT

SEQ ID NO: 253656 - protein, 20 aa, Homo sapiens
  Native (MAGC1_HUMAN)
SPSFSSTLVSLFQSSPERTQ

SEQ ID NO: 253657 - protein, 21 aa, Homo sapiens
  Native (MAGC1_HUMAN)
SPSFSSTLVSLFQSSPERTQS

SEQ ID NO: 253658 - protein, 22 aa, Homo sapiens
  Native (MAGC1_HUMAN)
SPSFSSTLVSLFQSSPERTQST

SEQ ID NO: 253659 - protein, 23 aa, Homo sapiens
  Native (MAGC1_HUMAN)
SPSFSSTLVSLFQSSPERTQSTF

SEQ ID NO: 253660 - protein, 24 aa, Homo sapiens
  Native (MAGC1_HUMAN)
SPSFSSTLVSLFQSSPERTQSTFE

SEQ ID NO: 253661 - protein, 25 aa, Homo sapiens
  Native (MAGC1_HUMAN)
SPSFSSTLVSLFQSSPERTQSTFEG

SEQ ID NO: 253662 - protein, 13 aa, Homo sapiens
  Native (MAGC1_HUMAN)
SPSSSSTLLSLFQ

SEQ ID NO: 253663 - protein, 14 aa, Homo sapiens
  Native (MAGC1_HUMAN)
SPSSSSTLLSLFQS

SEQ ID NO: 253664 - protein, 15 aa, Homo sapiens
  Native (MAGC1_HUMAN)
SPSSSSTLLSLFQSF

SEQ ID NO: 253665 - protein, 16 aa, Homo sapiens
  Native (MAGC1_HUMAN)
SPSSSSTLLSLFQSFS

SEQ ID NO: 253666 - protein, 17 aa, Homo sapiens
  Native (MAGC1_HUMAN)
SPSSSSTLLSLFQSFSE

SEQ ID NO: 253667 - protein, 18 aa, Homo sapiens
  Native (MAGC1_HUMAN)
SPSSSSTLLSLFQSFSER

SEQ ID NO: 253668 - protein, 19 aa, Homo sapiens
  Native (MAGC1_HUMAN)
SPSSSSTLLSLFQSFSERT

SEQ ID NO: 253669 - protein, 20 aa, Homo sapiens
  Native (MAGC1_HUMAN)
SPSSSSTLLSLFQSFSERTQ

SEQ ID NO: 253670 - protein, 21 aa, Homo sapiens
  Native (MAGC1_HUMAN)
SPSSSSTLLSLFQSFSERTQS

SEQ ID NO: 253671 - protein, 22 aa, Homo sapiens
  Native (MAGC1_HUMAN)
SPSSSSTLLSLFQSFSERTQST

SEQ ID NO: 253672 - protein, 23 aa, Homo sapiens
  Native (MAGC1_HUMAN)
SPSSSSTLLSLFQSFSERTQSTF

SEQ ID NO: 253673 - protein, 24 aa, Homo sapiens
  Native (MAGC1_HUMAN)
SPSSSSTLLSLFQSFSERTQSTFE

SEQ ID NO: 253674 - protein, 25 aa, Homo sapiens
  Native (MAGC1_HUMAN)
SPSSSSTLLSLFQSFSERTQSTFEG

SEQ ID NO: 253675 - protein, 16 aa, Homo sapiens
  Native (MAGC1_HUMAN)
SPVDEYTSSSDTLLES

SEQ ID NO: 253676 - protein, 19 aa, Homo sapiens
  Native (MAGC1_HUMAN)
SPVDEYTSSSDTLLESDSL

SEQ ID NO: 253677 - protein, 20 aa, Homo sapiens
  Native (MAGC1_HUMAN)
SPVDEYTSSSDTLLESDSLT

SEQ ID NO: 253678 - protein, 21 aa, Homo sapiens
  Native (MAGC1_HUMAN)
SPVDEYTSSSDTLLESDSLTD

SEQ ID NO: 253679 - protein, 22 aa, Homo sapiens
  Native (MAGC1_HUMAN)
SPVDEYTSSSDTLLESDSLTDS

SEQ ID NO: 253680 - protein, 23 aa, Homo sapiens
  Native (MAGC1_HUMAN)
SPVDEYTSSSDTLLESDSLTDSE

SEQ ID NO: 253681 - protein, 24 aa, Homo sapiens
  Native (MAGC1_HUMAN)
SPVDEYTSSSDTLLESDSLTDSES

SEQ ID NO: 253682 - protein, 25 aa, Homo sapiens
  Native (MAGC1_HUMAN)
SPVDEYTSSSDTLLESDSLTDSESL

SEQ ID NO: 253683 - protein, 13 aa, Homo sapiens
  Native (MAGC1_HUMAN)
SPVISFSSSTSLS

SEQ ID NO: 253684 - protein, 14 aa, Homo sapiens
  Native (MAGC1_HUMAN)
SPVISFSSSTSLSP

SEQ ID NO: 253685 - protein, 16 aa, Homo sapiens
  Native (MAGC1_HUMAN)
SPVISFSSSTSLSPFS

SEQ ID NO: 253686 - protein, 17 aa, Homo sapiens
  Native (MAGC1_HUMAN)
SPVISFSSSTSLSPFSE

SEQ ID NO: 253687 - protein, 18 aa, Homo sapiens
  Native (MAGC1_HUMAN)
SPVISFSSSTSLSPFSEE

SEQ ID NO: 253688 - protein, 19 aa, Homo sapiens
  Native (MAGC1_HUMAN)
SPVISFSSSTSLSPFSEES

SEQ ID NO: 253689 - protein, 20 aa, Homo sapiens
  Native (MAGC1_HUMAN)
SPVISFSSSTSLSPFSEESS

SEQ ID NO: 253690 - protein, 21 aa, Homo sapiens
  Native (MAGC1_HUMAN)
SPVISFSSSTSLSPFSEESSS

SEQ ID NO: 253691 - protein, 22 aa, Homo sapiens
  Native (MAGC1_HUMAN)
SPVISFSSSTSLSPFSEESSSP

SEQ ID NO: 253692 - protein, 23 aa, Homo sapiens
  Native (MAGC1_HUMAN)
SPVISFSSSTSLSPFSEESSSPV

SEQ ID NO: 253693 - protein, 24 aa, Homo sapiens
  Native (MAGC1_HUMAN)
SPVISFSSSTSLSPFSEESSSPVD

SEQ ID NO: 253694 - protein, 25 aa, Homo sapiens
  Native (MAGC1_HUMAN)
SPVISFSSSTSLSPFSEESSSPVDE

SEQ ID NO: 253695 - protein, 14 aa, Homo sapiens
  Native (MAGC1_HUMAN)
SPVSICSSSTPSSL

SEQ ID NO: 253696 - protein, 15 aa, Homo sapiens
  Native (MAGC1_HUMAN)
SPVSICSSSTPSSLP

SEQ ID NO: 253697 - protein, 16 aa, Homo sapiens
  Native (MAGC1_HUMAN)
SPVSICSSSTPSSLPQ

SEQ ID NO: 253698 - protein, 17 aa, Homo sapiens
  Native (MAGC1_HUMAN)
SPVSICSSSTPSSLPQS

SEQ ID NO: 253699 - protein, 18 aa, Homo sapiens
  Native (MAGC1_HUMAN)
SPVSICSSSTPSSLPQSF

SEQ ID NO: 253700 - protein, 19 aa, Homo sapiens
  Native (MAGC1_HUMAN)
SPVSICSSSTPSSLPQSFP

SEQ ID NO: 253701 - protein, 20 aa, Homo sapiens
  Native (MAGC1_HUMAN)
SPVSICSSSTPSSLPQSFPE

SEQ ID NO: 253702 - protein, 21 aa, Homo sapiens
  Native (MAGC1_HUMAN)
SPVSICSSSTPSSLPQSFPES

SEQ ID NO: 253703 - protein, 22 aa, Homo sapiens
  Native (MAGC1_HUMAN)
SPVSICSSSTPSSLPQSFPESS

SEQ ID NO: 253704 - protein, 23 aa, Homo sapiens
  Native (MAGC1_HUMAN)
SPVSICSSSTPSSLPQSFPESSQ

SEQ ID NO: 253705 - protein, 24 aa, Homo sapiens
  Native (MAGC1_HUMAN)
SPVSICSSSTPSSLPQSFPESSQS

SEQ ID NO: 253706 - protein, 25 aa, Homo sapiens
  Native (MAGC1_HUMAN)
SPVSICSSSTPSSLPQSFPESSQSP

SEQ ID NO: 253707 - protein, 13 aa, Homo sapiens
  Native (MAGC1_HUMAN)
SPVSICSSSTSLS

SEQ ID NO: 253708 - protein, 14 aa, Homo sapiens
  Native (MAGC1_HUMAN)
SPVSICSSSTSLSL

SEQ ID NO: 253709 - protein, 15 aa, Homo sapiens
  Native (MAGC1_HUMAN)
SPVSICSSSTSLSLP

SEQ ID NO: 253710 - protein, 16 aa, Homo sapiens
  Native (MAGC1_HUMAN)
SPVSICSSSTSLSLPQ

SEQ ID NO: 253711 - protein, 17 aa, Homo sapiens
  Native (MAGC1_HUMAN)
SPVSICSSSTSLSLPQS

SEQ ID NO: 253712 - protein, 18 aa, Homo sapiens
  Native (MAGC1_HUMAN)
SPVSICSSSTSLSLPQSF

SEQ ID NO: 253713 - protein, 19 aa, Homo sapiens
  Native (MAGC1_HUMAN)
SPVSICSSSTSLSLPQSFP

SEQ ID NO: 253714 - protein, 20 aa, Homo sapiens
  Native (MAGC1_HUMAN)
SPVSICSSSTSLSLPQSFPE

SEQ ID NO: 253715 - protein, 21 aa, Homo sapiens
  Native (MAGC1_HUMAN)
SPVSICSSSTSLSLPQSFPES

SEQ ID NO: 253716 - protein, 22 aa, Homo sapiens
  Native (MAGC1_HUMAN)
SPVSICSSSTSLSLPQSFPESP

SEQ ID NO: 253717 - protein, 23 aa, Homo sapiens
  Native (MAGC1_HUMAN)
SPVSICSSSTSLSLPQSFPESPQ

SEQ ID NO: 253718 - protein, 24 aa, Homo sapiens
  Native (MAGC1_HUMAN)
SPVSICSSSTSLSLPQSFPESPQS

SEQ ID NO: 253719 - protein, 25 aa, Homo sapiens
  Native (MAGC1_HUMAN)
SPVSICSSSTSLSLPQSFPESPQSP

SEQ ID NO: 253720 - protein, 14 aa, Homo sapiens
  Native (MAGC1_HUMAN)
SPVSSFPSSTSSSL

SEQ ID NO: 253721 - protein, 15 aa, Homo sapiens
  Native (MAGC1_HUMAN)
SPVSSFPSSTSSSLS

SEQ ID NO: 253722 - protein, 16 aa, Homo sapiens
  Native (MAGC1_HUMAN)
SPVSSFPSSTSSSLSK

SEQ ID NO: 253723 - protein, 17 aa, Homo sapiens
  Native (MAGC1_HUMAN)
SPVSSFPSSTSSSLSKS

SEQ ID NO: 253724 - protein, 18 aa, Homo sapiens
  Native (MAGC1_HUMAN)
SPVSSFPSSTSSSLSKSS

SEQ ID NO: 253725 - protein, 19 aa, Homo sapiens
  Native (MAGC1_HUMAN)
SPVSSFPSSTSSSLSKSSP

SEQ ID NO: 253726 - protein, 20 aa, Homo sapiens
  Native (MAGC1_HUMAN)
SPVSSFPSSTSSSLSKSSPE

SEQ ID NO: 253727 - protein, 21 aa, Homo sapiens
  Native (MAGC1_HUMAN)
SPVSSFPSSTSSSLSKSSPES

SEQ ID NO: 253728 - protein, 22 aa, Homo sapiens
  Native (MAGC1_HUMAN)
SPVSSFPSSTSSSLSKSSPESP

SEQ ID NO: 253729 - protein, 23 aa, Homo sapiens
  Native (MAGC1_HUMAN)
SPVSSFPSSTSSSLSKSSPESPL

SEQ ID NO: 253730 - protein, 24 aa, Homo sapiens
  Native (MAGC1_HUMAN)
SPVSSFPSSTSSSLSKSSPESPLQ

SEQ ID NO: 253731 - protein, 25 aa, Homo sapiens
  Native (MAGC1_HUMAN)
SPVSSFPSSTSSSLSKSSPESPLQS

SEQ ID NO: 253732 - protein, 16 aa, Homo sapiens
  Native (MAGC1_HUMAN)
SPVSSFPSSTSSSLSQ

SEQ ID NO: 253733 - protein, 17 aa, Homo sapiens
  Native (MAGC1_HUMAN)
SPVSSFPSSTSSSLSQS

SEQ ID NO: 253734 - protein, 18 aa, Homo sapiens
  Native (MAGC1_HUMAN)
SPVSSFPSSTSSSLSQSS

SEQ ID NO: 253735 - protein, 19 aa, Homo sapiens
  Native (MAGC1_HUMAN)
SPVSSFPSSTSSSLSQSSP

SEQ ID NO: 253736 - protein, 20 aa, Homo sapiens
  Native (MAGC1_HUMAN)
SPVSSFPSSTSSSLSQSSPV

SEQ ID NO: 253737 - protein, 21 aa, Homo sapiens
  Native (MAGC1_HUMAN)
SPVSSFPSSTSSSLSQSSPVS

SEQ ID NO: 253738 - protein, 22 aa, Homo sapiens
  Native (MAGC1_HUMAN)
SPVSSFPSSTSSSLSQSSPVSS

SEQ ID NO: 253739 - protein, 23 aa, Homo sapiens
  Native (MAGC1_HUMAN)
SPVSSFPSSTSSSLSQSSPVSSF

SEQ ID NO: 253740 - protein, 24 aa, Homo sapiens
  Native (MAGC1_HUMAN)
SPVSSFPSSTSSSLSQSSPVSSFP

SEQ ID NO: 253741 - protein, 25 aa, Homo sapiens
  Native (MAGC1_HUMAN)
SPVSSFPSSTSSSLSQSSPVSSFPS

SEQ ID NO: 253742 - protein, 13 aa, Homo sapiens
  Native (MAGC1_HUMAN)
SQNRLLILILSII

SEQ ID NO: 253743 - protein, 14 aa, Homo sapiens
  Native (MAGC1_HUMAN)
SQNRLLILILSIIF

SEQ ID NO: 253744 - protein, 15 aa, Homo sapiens
  Native (MAGC1_HUMAN)
SQNRLLILILSIIFI

SEQ ID NO: 253745 - protein, 16 aa, Homo sapiens
  Native (MAGC1_HUMAN)
SQNRLLILILSIIFIK

SEQ ID NO: 253746 - protein, 17 aa, Homo sapiens
  Native (MAGC1_HUMAN)
SQNRLLILILSIIFIKG

SEQ ID NO: 253747 - protein, 18 aa, Homo sapiens
  Native (MAGC1_HUMAN)
SQNRLLILILSIIFIKGT

SEQ ID NO: 253748 - protein, 19 aa, Homo sapiens
  Native (MAGC1_HUMAN)
SQNRLLILILSIIFIKGTY

SEQ ID NO: 253749 - protein, 20 aa, Homo sapiens
  Native (MAGC1_HUMAN)
SQNRLLILILSIIFIKGTYA

SEQ ID NO: 253750 - protein, 21 aa, Homo sapiens
  Native (MAGC1_HUMAN)
SQNRLLILILSIIFIKGTYAS

SEQ ID NO: 253751 - protein, 22 aa, Homo sapiens
  Native (MAGC1_HUMAN)
SQNRLLILILSIIFIKGTYASE

SEQ ID NO: 253752 - protein, 23 aa, Homo sapiens
  Native (MAGC1_HUMAN)
SQNRLLILILSIIFIKGTYASEE

SEQ ID NO: 253753 - protein, 24 aa, Homo sapiens
  Native (MAGC1_HUMAN)
SQNRLLILILSIIFIKGTYASEEV

SEQ ID NO: 253754 - protein, 25 aa, Homo sapiens
  Native (MAGC1_HUMAN)
SQNRLLILILSIIFIKGTYASEEVI

SEQ ID NO: 253755 - protein, 14 aa, Homo sapiens
  Native (MAGC1_HUMAN)
SQSSPVSSFPSSTS

SEQ ID NO: 253756 - protein, 15 aa, Homo sapiens
  Native (MAGC1_HUMAN)
SQSSPVSSFPSSTSS

SEQ ID NO: 253757 - protein, 16 aa, Homo sapiens
  Native (MAGC1_HUMAN)
SQSSPVSSFPSSTSSS

SEQ ID NO: 253758 - protein, 17 aa, Homo sapiens
  Native (MAGC1_HUMAN)
SQSSPVSSFPSSTSSSL

SEQ ID NO: 253759 - protein, 18 aa, Homo sapiens
  Native (MAGC1_HUMAN)
SQSSPVSSFPSSTSSSLS

SEQ ID NO: 253760 - protein, 19 aa, Homo sapiens
  Native (MAGC1_HUMAN)
SQSSPVSSFPSSTSSSLSK

SEQ ID NO: 253761 - protein, 20 aa, Homo sapiens
  Native (MAGC1_HUMAN)
SQSSPVSSFPSSTSSSLSKS

SEQ ID NO: 253762 - protein, 21 aa, Homo sapiens
  Native (MAGC1_HUMAN)
SQSSPVSSFPSSTSSSLSKSS

SEQ ID NO: 253763 - protein, 22 aa, Homo sapiens
  Native (MAGC1_HUMAN)
SQSSPVSSFPSSTSSSLSKSSP

SEQ ID NO: 253764 - protein, 23 aa, Homo sapiens
  Native (MAGC1_HUMAN)
SQSSPVSSFPSSTSSSLSKSSPE

SEQ ID NO: 253765 - protein, 24 aa, Homo sapiens
  Native (MAGC1_HUMAN)
SQSSPVSSFPSSTSSSLSKSSPES

SEQ ID NO: 253766 - protein, 25 aa, Homo sapiens
  Native (MAGC1_HUMAN)
SQSSPVSSFPSSTSSSLSKSSPESP

SEQ ID NO: 253767 - protein, 13 aa, Homo sapiens
  Native (MAGC1_HUMAN)
SRSFSSTLLSIFQ

SEQ ID NO: 253768 - protein, 14 aa, Homo sapiens
  Native (MAGC1_HUMAN)
SRSFSSTLLSIFQS

SEQ ID NO: 253769 - protein, 15 aa, Homo sapiens
  Native (MAGC1_HUMAN)
SRSFSSTLLSIFQSS

SEQ ID NO: 253770 - protein, 16 aa, Homo sapiens
  Native (MAGC1_HUMAN)
SRSFSSTLLSIFQSSP

SEQ ID NO: 253771 - protein, 17 aa, Homo sapiens
  Native (MAGC1_HUMAN)
SRSFSSTLLSIFQSSPE

SEQ ID NO: 253772 - protein, 18 aa, Homo sapiens
  Native (MAGC1_HUMAN)
SRSFSSTLLSIFQSSPER

SEQ ID NO: 253773 - protein, 19 aa, Homo sapiens
  Native (MAGC1_HUMAN)
SRSFSSTLLSIFQSSPERT

SEQ ID NO: 253774 - protein, 20 aa, Homo sapiens
  Native (MAGC1_HUMAN)
SRSFSSTLLSIFQSSPERTQ

SEQ ID NO: 253775 - protein, 21 aa, Homo sapiens
  Native (MAGC1_HUMAN)
SRSFSSTLLSIFQSSPERTQS

SEQ ID NO: 253776 - protein, 22 aa, Homo sapiens
  Native (MAGC1_HUMAN)
SRSFSSTLLSIFQSSPERTQST

SEQ ID NO: 253777 - protein, 23 aa, Homo sapiens
  Native (MAGC1_HUMAN)
SRSFSSTLLSIFQSSPERTQSTF

SEQ ID NO: 253778 - protein, 24 aa, Homo sapiens
  Native (MAGC1_HUMAN)
SRSFSSTLLSIFQSSPERTQSTFE

SEQ ID NO: 253779 - protein, 25 aa, Homo sapiens
  Native (MAGC1_HUMAN)
SRSFSSTLLSIFQSSPERTQSTFEG

SEQ ID NO: 253780 - protein, 13 aa, Homo sapiens
  Native (MAGC1_HUMAN)
SRYTGYFPVIFRK

SEQ ID NO: 253781 - protein, 14 aa, Homo sapiens
  Native (MAGC1_HUMAN)
SRYTGYFPVIFRKA

SEQ ID NO: 253782 - protein, 15 aa, Homo sapiens
  Native (MAGC1_HUMAN)
SRYTGYFPVIFRKAR

SEQ ID NO: 253783 - protein, 16 aa, Homo sapiens
  Native (MAGC1_HUMAN)
SRYTGYFPVIFRKARE

SEQ ID NO: 253784 - protein, 17 aa, Homo sapiens
  Native (MAGC1_HUMAN)
SRYTGYFPVIFRKAREF

SEQ ID NO: 253785 - protein, 18 aa, Homo sapiens
  Native (MAGC1_HUMAN)
SRYTGYFPVIFRKAREFI

SEQ ID NO: 253786 - protein, 19 aa, Homo sapiens
  Native (MAGC1_HUMAN)
SRYTGYFPVIFRKAREFIE

SEQ ID NO: 253787 - protein, 20 aa, Homo sapiens
  Native (MAGC1_HUMAN)
SRYTGYFPVIFRKAREFIEI

SEQ ID NO: 253788 - protein, 21 aa, Homo sapiens
  Native (MAGC1_HUMAN)
SRYTGYFPVIFRKAREFIEIL

SEQ ID NO: 253789 - protein, 22 aa, Homo sapiens
  Native (MAGC1_HUMAN)
SRYTGYFPVIFRKAREFIEILF

SEQ ID NO: 253790 - protein, 23 aa, Homo sapiens
  Native (MAGC1_HUMAN)
SRYTGYFPVIFRKAREFIEILFG

SEQ ID NO: 253791 - protein, 24 aa, Homo sapiens
  Native (MAGC1_HUMAN)
SRYTGYFPVIFRKAREFIEILFGI

SEQ ID NO: 253792 - protein, 25 aa, Homo sapiens
  Native (MAGC1_HUMAN)
SRYTGYFPVIFRKAREFIEILFGIS

SEQ ID NO: 253793 - protein, 13 aa, Homo sapiens
  Native (MAGC1_HUMAN)
SSALLSIFQSSPE

SEQ ID NO: 253794 - protein, 14 aa, Homo sapiens
  Native (MAGC1_HUMAN)
SSALLSIFQSSPES

SEQ ID NO: 253795 - protein, 15 aa, Homo sapiens
  Native (MAGC1_HUMAN)
SSALLSIFQSSPEST

SEQ ID NO: 253796 - protein, 16 aa, Homo sapiens
  Native (MAGC1_HUMAN)
SSALLSIFQSSPESTQ

SEQ ID NO: 253797 - protein, 17 aa, Homo sapiens
  Native (MAGC1_HUMAN)
SSALLSIFQSSPESTQS

SEQ ID NO: 253798 - protein, 18 aa, Homo sapiens
  Native (MAGC1_HUMAN)
SSALLSIFQSSPESTQSP

SEQ ID NO: 253799 - protein, 19 aa, Homo sapiens
  Native (MAGC1_HUMAN)
SSALLSIFQSSPESTQSPF

SEQ ID NO: 253800 - protein, 20 aa, Homo sapiens
  Native (MAGC1_HUMAN)
SSALLSIFQSSPESTQSPFE

SEQ ID NO: 253801 - protein, 21 aa, Homo sapiens
  Native (MAGC1_HUMAN)
SSALLSIFQSSPESTQSPFEG

SEQ ID NO: 253802 - protein, 22 aa, Homo sapiens
  Native (MAGC1_HUMAN)
SSALLSIFQSSPESTQSPFEGF

SEQ ID NO: 253803 - protein, 23 aa, Homo sapiens
  Native (MAGC1_HUMAN)
SSALLSIFQSSPESTQSPFEGFP

SEQ ID NO: 253804 - protein, 24 aa, Homo sapiens
  Native (MAGC1_HUMAN)
SSALLSIFQSSPESTQSPFEGFPQ

SEQ ID NO: 253805 - protein, 25 aa, Homo sapiens
  Native (MAGC1_HUMAN)
SSALLSIFQSSPESTQSPFEGFPQS

SEQ ID NO: 253806 - protein, 25 aa, Homo sapiens
  Native (MAGC1_HUMAN)
SSDTLLESDSLTDSESLIESEPLFT

SEQ ID NO: 253807 - protein, 13 aa, Homo sapiens
  Native (MAGC1_HUMAN)
SSFFSSALLSIFQ

SEQ ID NO: 253808 - protein, 14 aa, Homo sapiens
  Native (MAGC1_HUMAN)
SSFFSSALLSIFQS

SEQ ID NO: 253809 - protein, 15 aa, Homo sapiens
  Native (MAGC1_HUMAN)
SSFFSSALLSIFQSS

SEQ ID NO: 253810 - protein, 16 aa, Homo sapiens
  Native (MAGC1_HUMAN)
SSFFSSALLSIFQSSP

SEQ ID NO: 253811 - protein, 17 aa, Homo sapiens
  Native (MAGC1_HUMAN)
SSFFSSALLSIFQSSPE

SEQ ID NO: 253812 - protein, 18 aa, Homo sapiens
  Native (MAGC1_HUMAN)
SSFFSSALLSIFQSSPES

SEQ ID NO: 253813 - protein, 19 aa, Homo sapiens
  Native (MAGC1_HUMAN)
SSFFSSALLSIFQSSPEST

SEQ ID NO: 253814 - protein, 20 aa, Homo sapiens
  Native (MAGC1_HUMAN)
SSFFSSALLSIFQSSPESTQ

SEQ ID NO: 253815 - protein, 21 aa, Homo sapiens
  Native (MAGC1_HUMAN)
SSFFSSALLSIFQSSPESTQS

SEQ ID NO: 253816 - protein, 22 aa, Homo sapiens
  Native (MAGC1_HUMAN)
SSFFSSALLSIFQSSPESTQSP

SEQ ID NO: 253817 - protein, 23 aa, Homo sapiens
  Native (MAGC1_HUMAN)
SSFFSSALLSIFQSSPESTQSPF

SEQ ID NO: 253818 - protein, 24 aa, Homo sapiens
  Native (MAGC1_HUMAN)
SSFFSSALLSIFQSSPESTQSPFE

SEQ ID NO: 253819 - protein, 25 aa, Homo sapiens
  Native (MAGC1_HUMAN)
SSFFSSALLSIFQSSPESTQSPFEG

SEQ ID NO: 253820 - protein, 13 aa, Homo sapiens
  Native (MAGC1_HUMAN)
SSFFSYTLASLLQ

SEQ ID NO: 253821 - protein, 14 aa, Homo sapiens
  Native (MAGC1_HUMAN)
SSFFSYTLASLLQS

SEQ ID NO: 253822 - protein, 15 aa, Homo sapiens
  Native (MAGC1_HUMAN)
SSFFSYTLASLLQSS

SEQ ID NO: 253823 - protein, 16 aa, Homo sapiens
  Native (MAGC1_HUMAN)
SSFFSYTLASLLQSSH

SEQ ID NO: 253824 - protein, 17 aa, Homo sapiens
  Native (MAGC1_HUMAN)
SSFFSYTLASLLQSSHE

SEQ ID NO: 253825 - protein, 18 aa, Homo sapiens
  Native (MAGC1_HUMAN)
SSFFSYTLASLLQSSHES

SEQ ID NO: 253826 - protein, 19 aa, Homo sapiens
  Native (MAGC1_HUMAN)
SSFFSYTLASLLQSSHESP

SEQ ID NO: 253827 - protein, 20 aa, Homo sapiens
  Native (MAGC1_HUMAN)
SSFFSYTLASLLQSSHESPQ

SEQ ID NO: 253828 - protein, 21 aa, Homo sapiens
  Native (MAGC1_HUMAN)
SSFFSYTLASLLQSSHESPQS

SEQ ID NO: 253829 - protein, 22 aa, Homo sapiens
  Native (MAGC1_HUMAN)
SSFFSYTLASLLQSSHESPQSP

SEQ ID NO: 253830 - protein, 23 aa, Homo sapiens
  Native (MAGC1_HUMAN)
SSFFSYTLASLLQSSHESPQSPP

SEQ ID NO: 253831 - protein, 24 aa, Homo sapiens
  Native (MAGC1_HUMAN)
SSFFSYTLASLLQSSHESPQSPPE

SEQ ID NO: 253832 - protein, 25 aa, Homo sapiens
  Native (MAGC1_HUMAN)
SSFFSYTLASLLQSSHESPQSPPEG

SEQ ID NO: 253833 - protein, 14 aa, Homo sapiens
  Native (MAGC1_HUMAN)
SSFPSSTSSSLSKS

SEQ ID NO: 253834 - protein, 15 aa, Homo sapiens
  Native (MAGC1_HUMAN)
SSFPSSTSSSLSKSS

SEQ ID NO: 253835 - protein, 16 aa, Homo sapiens
  Native (MAGC1_HUMAN)
SSFPSSTSSSLSKSSP

SEQ ID NO: 253836 - protein, 17 aa, Homo sapiens
  Native (MAGC1_HUMAN)
SSFPSSTSSSLSKSSPE

SEQ ID NO: 253837 - protein, 18 aa, Homo sapiens
  Native (MAGC1_HUMAN)
SSFPSSTSSSLSKSSPES

SEQ ID NO: 253838 - protein, 19 aa, Homo sapiens
  Native (MAGC1_HUMAN)
SSFPSSTSSSLSKSSPESP

SEQ ID NO: 253839 - protein, 20 aa, Homo sapiens
  Native (MAGC1_HUMAN)
SSFPSSTSSSLSKSSPESPL

SEQ ID NO: 253840 - protein, 21 aa, Homo sapiens
  Native (MAGC1_HUMAN)
SSFPSSTSSSLSKSSPESPLQ

SEQ ID NO: 253841 - protein, 22 aa, Homo sapiens
  Native (MAGC1_HUMAN)
SSFPSSTSSSLSKSSPESPLQS

SEQ ID NO: 253842 - protein, 23 aa, Homo sapiens
  Native (MAGC1_HUMAN)
SSFPSSTSSSLSKSSPESPLQSP

SEQ ID NO: 253843 - protein, 24 aa, Homo sapiens
  Native (MAGC1_HUMAN)
SSFPSSTSSSLSKSSPESPLQSPV

SEQ ID NO: 253844 - protein, 25 aa, Homo sapiens
  Native (MAGC1_HUMAN)
SSFPSSTSSSLSKSSPESPLQSPVI

SEQ ID NO: 253845 - protein, 14 aa, Homo sapiens
  Native (MAGC1_HUMAN)
SSFPSSTSSSLSQS

SEQ ID NO: 253846 - protein, 15 aa, Homo sapiens
  Native (MAGC1_HUMAN)
SSFPSSTSSSLSQSS

SEQ ID NO: 253847 - protein, 16 aa, Homo sapiens
  Native (MAGC1_HUMAN)
SSFPSSTSSSLSQSSP

SEQ ID NO: 253848 - protein, 17 aa, Homo sapiens
  Native (MAGC1_HUMAN)
SSFPSSTSSSLSQSSPV

SEQ ID NO: 253849 - protein, 18 aa, Homo sapiens
  Native (MAGC1_HUMAN)
SSFPSSTSSSLSQSSPVS

SEQ ID NO: 253850 - protein, 19 aa, Homo sapiens
  Native (MAGC1_HUMAN)
SSFPSSTSSSLSQSSPVSS

SEQ ID NO: 253851 - protein, 20 aa, Homo sapiens
  Native (MAGC1_HUMAN)
SSFPSSTSSSLSQSSPVSSF

SEQ ID NO: 253852 - protein, 21 aa, Homo sapiens
  Native (MAGC1_HUMAN)
SSFPSSTSSSLSQSSPVSSFP

SEQ ID NO: 253853 - protein, 22 aa, Homo sapiens
  Native (MAGC1_HUMAN)
SSFPSSTSSSLSQSSPVSSFPS

SEQ ID NO: 253854 - protein, 23 aa, Homo sapiens
  Native (MAGC1_HUMAN)
SSFPSSTSSSLSQSSPVSSFPSS

SEQ ID NO: 253855 - protein, 24 aa, Homo sapiens
  Native (MAGC1_HUMAN)
SSFPSSTSSSLSQSSPVSSFPSST

SEQ ID NO: 253856 - protein, 25 aa, Homo sapiens
  Native (MAGC1_HUMAN)
SSFPSSTSSSLSQSSPVSSFPSSTS

SEQ ID NO: 253857 - protein, 13 aa, Homo sapiens
  Native (MAGC1_HUMAN)
SSFSSTLLSIFQS

SEQ ID NO: 253858 - protein, 14 aa, Homo sapiens
  Native (MAGC1_HUMAN)
SSFSSTLLSIFQSS

SEQ ID NO: 253859 - protein, 15 aa, Homo sapiens
  Native (MAGC1_HUMAN)
SSFSSTLLSIFQSSP

SEQ ID NO: 253860 - protein, 16 aa, Homo sapiens
  Native (MAGC1_HUMAN)
SSFSSTLLSIFQSSPE

SEQ ID NO: 253861 - protein, 17 aa, Homo sapiens
  Native (MAGC1_HUMAN)
SSFSSTLLSIFQSSPES

SEQ ID NO: 253862 - protein, 18 aa, Homo sapiens
  Native (MAGC1_HUMAN)
SSFSSTLLSIFQSSPESA

SEQ ID NO: 253863 - protein, 19 aa, Homo sapiens
  Native (MAGC1_HUMAN)
SSFSSTLLSIFQSSPESAQ

SEQ ID NO: 253864 - protein, 20 aa, Homo sapiens
  Native (MAGC1_HUMAN)
SSFSSTLLSIFQSSPESAQS

SEQ ID NO: 253865 - protein, 21 aa, Homo sapiens
  Native (MAGC1_HUMAN)
SSFSSTLLSIFQSSPESAQST

SEQ ID NO: 253866 - protein, 22 aa, Homo sapiens
  Native (MAGC1_HUMAN)
SSFSSTLLSIFQSSPESAQSTF

SEQ ID NO: 253867 - protein, 23 aa, Homo sapiens
  Native (MAGC1_HUMAN)
SSFSSTLLSIFQSSPESAQSTFE

SEQ ID NO: 253868 - protein, 24 aa, Homo sapiens
  Native (MAGC1_HUMAN)
SSFSSTLLSIFQSSPESAQSTFEG

SEQ ID NO: 253869 - protein, 25 aa, Homo sapiens
  Native (MAGC1_HUMAN)
SSFSSTLLSIFQSSPESAQSTFEGF

SEQ ID NO: 253870 - protein, 13 aa, Homo sapiens
  Native (MAGC1_HUMAN)
SSFSSTLLSILQS

SEQ ID NO: 253871 - protein, 14 aa, Homo sapiens
  Native (MAGC1_HUMAN)
SSFSSTLLSILQSS

SEQ ID NO: 253872 - protein, 15 aa, Homo sapiens
  Native (MAGC1_HUMAN)
SSFSSTLLSILQSSP

SEQ ID NO: 253873 - protein, 16 aa, Homo sapiens
  Native (MAGC1_HUMAN)
SSFSSTLLSILQSSPE

SEQ ID NO: 253874 - protein, 17 aa, Homo sapiens
  Native (MAGC1_HUMAN)
SSFSSTLLSILQSSPES

SEQ ID NO: 253875 - protein, 18 aa, Homo sapiens
  Native (MAGC1_HUMAN)
SSFSSTLLSILQSSPESA

SEQ ID NO: 253876 - protein, 19 aa, Homo sapiens
  Native (MAGC1_HUMAN)
SSFSSTLLSILQSSPESAQ

SEQ ID NO: 253877 - protein, 20 aa, Homo sapiens
  Native (MAGC1_HUMAN)
SSFSSTLLSILQSSPESAQS

SEQ ID NO: 253878 - protein, 21 aa, Homo sapiens
  Native (MAGC1_HUMAN)
SSFSSTLLSILQSSPESAQSA

SEQ ID NO: 253879 - protein, 22 aa, Homo sapiens
  Native (MAGC1_HUMAN)
SSFSSTLLSILQSSPESAQSAF

SEQ ID NO: 253880 - protein, 23 aa, Homo sapiens
  Native (MAGC1_HUMAN)
SSFSSTLLSILQSSPESAQSAFE

SEQ ID NO: 253881 - protein, 24 aa, Homo sapiens
  Native (MAGC1_HUMAN)
SSFSSTLLSILQSSPESAQSAFEG

SEQ ID NO: 253882 - protein, 25 aa, Homo sapiens
  Native (MAGC1_HUMAN)
SSFSSTLLSILQSSPESAQSAFEGF

SEQ ID NO: 253883 - protein, 13 aa, Homo sapiens
  Native (MAGC1_HUMAN)
SSFSYTLLSLFQS

SEQ ID NO: 253884 - protein, 14 aa, Homo sapiens
  Native (MAGC1_HUMAN)
SSFSYTLLSLFQSS

SEQ ID NO: 253885 - protein, 15 aa, Homo sapiens
  Native (MAGC1_HUMAN)
SSFSYTLLSLFQSSP

SEQ ID NO: 253886 - protein, 16 aa, Homo sapiens
  Native (MAGC1_HUMAN)
SSFSYTLLSLFQSSPE

SEQ ID NO: 253887 - protein, 17 aa, Homo sapiens
  Native (MAGC1_HUMAN)
SSFSYTLLSLFQSSPER

SEQ ID NO: 253888 - protein, 18 aa, Homo sapiens
  Native (MAGC1_HUMAN)
SSFSYTLLSLFQSSPERT

SEQ ID NO: 253889 - protein, 19 aa, Homo sapiens
  Native (MAGC1_HUMAN)
SSFSYTLLSLFQSSPERTH

SEQ ID NO: 253890 - protein, 20 aa, Homo sapiens
  Native (MAGC1_HUMAN)
SSFSYTLLSLFQSSPERTHS

SEQ ID NO: 253891 - protein, 21 aa, Homo sapiens
  Native (MAGC1_HUMAN)
SSFSYTLLSLFQSSPERTHST

SEQ ID NO: 253892 - protein, 22 aa, Homo sapiens
  Native (MAGC1_HUMAN)
SSFSYTLLSLFQSSPERTHSTF

SEQ ID NO: 253893 - protein, 23 aa, Homo sapiens
  Native (MAGC1_HUMAN)
SSFSYTLLSLFQSSPERTHSTFE

SEQ ID NO: 253894 - protein, 24 aa, Homo sapiens
  Native (MAGC1_HUMAN)
SSFSYTLLSLFQSSPERTHSTFEG

SEQ ID NO: 253895 - protein, 25 aa, Homo sapiens
  Native (MAGC1_HUMAN)
SSFSYTLLSLFQSSPERTHSTFEGF

SEQ ID NO: 253896 - protein, 25 aa, Homo sapiens
  Native (MAGC1_HUMAN)
SSLHFPQSPPEWEDSLSPLHFPQFP

SEQ ID NO: 253897 - protein, 15 aa, Homo sapiens
  Native (MAGC1_HUMAN)
SSLQIPVSPSFSSTL

SEQ ID NO: 253898 - protein, 16 aa, Homo sapiens
  Native (MAGC1_HUMAN)
SSLQIPVSPSFSSTLV

SEQ ID NO: 253899 - protein, 17 aa, Homo sapiens
  Native (MAGC1_HUMAN)
SSLQIPVSPSFSSTLVS

SEQ ID NO: 253900 - protein, 18 aa, Homo sapiens
  Native (MAGC1_HUMAN)
SSLQIPVSPSFSSTLVSL

SEQ ID NO: 253901 - protein, 19 aa, Homo sapiens
  Native (MAGC1_HUMAN)
SSLQIPVSPSFSSTLVSLF

SEQ ID NO: 253902 - protein, 20 aa, Homo sapiens
  Native (MAGC1_HUMAN)
SSLQIPVSPSFSSTLVSLFQ

SEQ ID NO: 253903 - protein, 21 aa, Homo sapiens
  Native (MAGC1_HUMAN)
SSLQIPVSPSFSSTLVSLFQS

SEQ ID NO: 253904 - protein, 22 aa, Homo sapiens
  Native (MAGC1_HUMAN)
SSLQIPVSPSFSSTLVSLFQSS

SEQ ID NO: 253905 - protein, 23 aa, Homo sapiens
  Native (MAGC1_HUMAN)
SSLQIPVSPSFSSTLVSLFQSSP

SEQ ID NO: 253906 - protein, 24 aa, Homo sapiens
  Native (MAGC1_HUMAN)
SSLQIPVSPSFSSTLVSLFQSSPE

SEQ ID NO: 253907 - protein, 25 aa, Homo sapiens
  Native (MAGC1_HUMAN)
SSLQIPVSPSFSSTLVSLFQSSPER

SEQ ID NO: 253908 - protein, 15 aa, Homo sapiens
  Native (MAGC1_HUMAN)
SSLQSPVSICSSSTP

SEQ ID NO: 253909 - protein, 16 aa, Homo sapiens
  Native (MAGC1_HUMAN)
SSLQSPVSICSSSTPS

SEQ ID NO: 253910 - protein, 17 aa, Homo sapiens
  Native (MAGC1_HUMAN)
SSLQSPVSICSSSTPSS

SEQ ID NO: 253911 - protein, 18 aa, Homo sapiens
  Native (MAGC1_HUMAN)
SSLQSPVSICSSSTPSSL

SEQ ID NO: 253912 - protein, 19 aa, Homo sapiens
  Native (MAGC1_HUMAN)
SSLQSPVSICSSSTPSSLP

SEQ ID NO: 253913 - protein, 20 aa, Homo sapiens
  Native (MAGC1_HUMAN)
SSLQSPVSICSSSTPSSLPQ

SEQ ID NO: 253914 - protein, 21 aa, Homo sapiens
  Native (MAGC1_HUMAN)
SSLQSPVSICSSSTPSSLPQS

SEQ ID NO: 253915 - protein, 22 aa, Homo sapiens
  Native (MAGC1_HUMAN)
SSLQSPVSICSSSTPSSLPQSF

SEQ ID NO: 253916 - protein, 23 aa, Homo sapiens
  Native (MAGC1_HUMAN)
SSLQSPVSICSSSTPSSLPQSFP

SEQ ID NO: 253917 - protein, 24 aa, Homo sapiens
  Native (MAGC1_HUMAN)
SSLQSPVSICSSSTPSSLPQSFPE

SEQ ID NO: 253918 - protein, 25 aa, Homo sapiens
  Native (MAGC1_HUMAN)
SSLQSPVSICSSSTPSSLPQSFPES

SEQ ID NO: 253919 - protein, 15 aa, Homo sapiens
  Native (MAGC1_HUMAN)
SSLQSPVSICSSSTS

SEQ ID NO: 253920 - protein, 16 aa, Homo sapiens
  Native (MAGC1_HUMAN)
SSLQSPVSICSSSTSL

SEQ ID NO: 253921 - protein, 17 aa, Homo sapiens
  Native (MAGC1_HUMAN)
SSLQSPVSICSSSTSLS

SEQ ID NO: 253922 - protein, 18 aa, Homo sapiens
  Native (MAGC1_HUMAN)
SSLQSPVSICSSSTSLSL

SEQ ID NO: 253923 - protein, 19 aa, Homo sapiens
  Native (MAGC1_HUMAN)
SSLQSPVSICSSSTSLSLP

SEQ ID NO: 253924 - protein, 20 aa, Homo sapiens
  Native (MAGC1_HUMAN)
SSLQSPVSICSSSTSLSLPQ

SEQ ID NO: 253925 - protein, 21 aa, Homo sapiens
  Native (MAGC1_HUMAN)
SSLQSPVSICSSSTSLSLPQS

SEQ ID NO: 253926 - protein, 22 aa, Homo sapiens
  Native (MAGC1_HUMAN)
SSLQSPVSICSSSTSLSLPQSF

SEQ ID NO: 253927 - protein, 23 aa, Homo sapiens
  Native (MAGC1_HUMAN)
SSLQSPVSICSSSTSLSLPQSFP

SEQ ID NO: 253928 - protein, 24 aa, Homo sapiens
  Native (MAGC1_HUMAN)
SSLQSPVSICSSSTSLSLPQSFPE

SEQ ID NO: 253929 - protein, 25 aa, Homo sapiens
  Native (MAGC1_HUMAN)
SSLQSPVSICSSSTSLSLPQSFPES

SEQ ID NO: 253930 - protein, 24 aa, Homo sapiens
  Native (MAGC1_HUMAN)
SSLSKSSPESPLQSPVISFSSSTS

SEQ ID NO: 253931 - protein, 25 aa, Homo sapiens
  Native (MAGC1_HUMAN)
SSLSKSSPESPLQSPVISFSSSTSL

SEQ ID NO: 253932 - protein, 13 aa, Homo sapiens
  Native (MAGC1_HUMAN)
SSLSQSSPVSSFP

SEQ ID NO: 253933 - protein, 14 aa, Homo sapiens
  Native (MAGC1_HUMAN)
SSLSQSSPVSSFPS

SEQ ID NO: 253934 - protein, 15 aa, Homo sapiens
  Native (MAGC1_HUMAN)
SSLSQSSPVSSFPSS

SEQ ID NO: 253935 - protein, 16 aa, Homo sapiens
  Native (MAGC1_HUMAN)
SSLSQSSPVSSFPSST

SEQ ID NO: 253936 - protein, 17 aa, Homo sapiens
  Native (MAGC1_HUMAN)
SSLSQSSPVSSFPSSTS

SEQ ID NO: 253937 - protein, 18 aa, Homo sapiens
  Native (MAGC1_HUMAN)
SSLSQSSPVSSFPSSTSS

SEQ ID NO: 253938 - protein, 19 aa, Homo sapiens
  Native (MAGC1_HUMAN)
SSLSQSSPVSSFPSSTSSS

SEQ ID NO: 253939 - protein, 20 aa, Homo sapiens
  Native (MAGC1_HUMAN)
SSLSQSSPVSSFPSSTSSSL

SEQ ID NO: 253940 - protein, 21 aa, Homo sapiens
  Native (MAGC1_HUMAN)
SSLSQSSPVSSFPSSTSSSLS

SEQ ID NO: 253941 - protein, 22 aa, Homo sapiens
  Native (MAGC1_HUMAN)
SSLSQSSPVSSFPSSTSSSLSK

SEQ ID NO: 253942 - protein, 23 aa, Homo sapiens
  Native (MAGC1_HUMAN)
SSLSQSSPVSSFPSSTSSSLSKS

SEQ ID NO: 253943 - protein, 24 aa, Homo sapiens
  Native (MAGC1_HUMAN)
SSLSQSSPVSSFPSSTSSSLSKSS

SEQ ID NO: 253944 - protein, 25 aa, Homo sapiens
  Native (MAGC1_HUMAN)
SSLSQSSPVSSFPSSTSSSLSKSSP

SEQ ID NO: 253945 - protein, 15 aa, Homo sapiens
  Native (MAGC1_HUMAN)
SSPECTQSTFEGFPQ

SEQ ID NO: 253946 - protein, 19 aa, Homo sapiens
  Native (MAGC1_HUMAN)
SSPECTQSTFEGFPQSPLQ

SEQ ID NO: 253947 - protein, 20 aa, Homo sapiens
  Native (MAGC1_HUMAN)
SSPECTQSTFEGFPQSPLQI

SEQ ID NO: 253948 - protein, 21 aa, Homo sapiens
  Native (MAGC1_HUMAN)
SSPECTQSTFEGFPQSPLQIP

SEQ ID NO: 253949 - protein, 22 aa, Homo sapiens
  Native (MAGC1_HUMAN)
SSPECTQSTFEGFPQSPLQIPQ

SEQ ID NO: 253950 - protein, 23 aa, Homo sapiens
  Native (MAGC1_HUMAN)
SSPECTQSTFEGFPQSPLQIPQS

SEQ ID NO: 253951 - protein, 24 aa, Homo sapiens
  Native (MAGC1_HUMAN)
SSPECTQSTFEGFPQSPLQIPQSP

SEQ ID NO: 253952 - protein, 25 aa, Homo sapiens
  Native (MAGC1_HUMAN)
SSPECTQSTFEGFPQSPLQIPQSPP

SEQ ID NO: 253953 - protein, 20 aa, Homo sapiens
  Native (MAGC1_HUMAN)
SSPEGKDSLSPLEISQSPPE

SEQ ID NO: 253954 - protein, 16 aa, Homo sapiens
  Native (MAGC1_HUMAN)
SSPERTHSTFEGFPQS

SEQ ID NO: 253955 - protein, 17 aa, Homo sapiens
  Native (MAGC1_HUMAN)
SSPERTHSTFEGFPQSL

SEQ ID NO: 253956 - protein, 18 aa, Homo sapiens
  Native (MAGC1_HUMAN)
SSPERTHSTFEGFPQSLL

SEQ ID NO: 253957 - protein, 19 aa, Homo sapiens
  Native (MAGC1_HUMAN)
SSPERTHSTFEGFPQSLLQ

SEQ ID NO: 253958 - protein, 20 aa, Homo sapiens
  Native (MAGC1_HUMAN)
SSPERTHSTFEGFPQSLLQI

SEQ ID NO: 253959 - protein, 21 aa, Homo sapiens
  Native (MAGC1_HUMAN)
SSPERTHSTFEGFPQSLLQIP

SEQ ID NO: 253960 - protein, 22 aa, Homo sapiens
  Native (MAGC1_HUMAN)
SSPERTHSTFEGFPQSLLQIPM

SEQ ID NO: 253961 - protein, 23 aa, Homo sapiens
  Native (MAGC1_HUMAN)
SSPERTHSTFEGFPQSLLQIPMT

SEQ ID NO: 253962 - protein, 24 aa, Homo sapiens
  Native (MAGC1_HUMAN)
SSPERTHSTFEGFPQSLLQIPMTS

SEQ ID NO: 253963 - protein, 25 aa, Homo sapiens
  Native (MAGC1_HUMAN)
SSPERTHSTFEGFPQSLLQIPMTSS

SEQ ID NO: 253964 - protein, 19 aa, Homo sapiens
  Native (MAGC1_HUMAN)
SSPERTHSTFEGFPQSPLQ

SEQ ID NO: 253965 - protein, 20 aa, Homo sapiens
  Native (MAGC1_HUMAN)
SSPERTHSTFEGFPQSPLQI

SEQ ID NO: 253966 - protein, 21 aa, Homo sapiens
  Native (MAGC1_HUMAN)
SSPERTHSTFEGFPQSPLQIP

SEQ ID NO: 253967 - protein, 22 aa, Homo sapiens
  Native (MAGC1_HUMAN)
SSPERTHSTFEGFPQSPLQIPM

SEQ ID NO: 253968 - protein, 23 aa, Homo sapiens
  Native (MAGC1_HUMAN)
SSPERTHSTFEGFPQSPLQIPMT

SEQ ID NO: 253969 - protein, 24 aa, Homo sapiens
  Native (MAGC1_HUMAN)
SSPERTHSTFEGFPQSPLQIPMTS

SEQ ID NO: 253970 - protein, 25 aa, Homo sapiens
  Native (MAGC1_HUMAN)
SSPERTHSTFEGFPQSPLQIPMTSS

SEQ ID NO: 253971 - protein, 22 aa, Homo sapiens
  Native (MAGC1_HUMAN)
SSPERTHSTFEGFPQSPLQIPV

SEQ ID NO: 253972 - protein, 23 aa, Homo sapiens
  Native (MAGC1_HUMAN)
SSPERTHSTFEGFPQSPLQIPVS

SEQ ID NO: 253973 - protein, 24 aa, Homo sapiens
  Native (MAGC1_HUMAN)
SSPERTHSTFEGFPQSPLQIPVSS

SEQ ID NO: 253974 - protein, 25 aa, Homo sapiens
  Native (MAGC1_HUMAN)
SSPERTHSTFEGFPQSPLQIPVSSS

SEQ ID NO: 253975 - protein, 15 aa, Homo sapiens
  Native (MAGC1_HUMAN)
SSPERTQSTFEGFAQ

SEQ ID NO: 253976 - protein, 16 aa, Homo sapiens
  Native (MAGC1_HUMAN)
SSPERTQSTFEGFAQS

SEQ ID NO: 253977 - protein, 17 aa, Homo sapiens
  Native (MAGC1_HUMAN)
SSPERTQSTFEGFAQSP

SEQ ID NO: 253978 - protein, 18 aa, Homo sapiens
  Native (MAGC1_HUMAN)
SSPERTQSTFEGFAQSPL

SEQ ID NO: 253979 - protein, 19 aa, Homo sapiens
  Native (MAGC1_HUMAN)
SSPERTQSTFEGFAQSPLQ

SEQ ID NO: 253980 - protein, 20 aa, Homo sapiens
  Native (MAGC1_HUMAN)
SSPERTQSTFEGFAQSPLQI

SEQ ID NO: 253981 - protein, 21 aa, Homo sapiens
  Native (MAGC1_HUMAN)
SSPERTQSTFEGFAQSPLQIP

SEQ ID NO: 253982 - protein, 22 aa, Homo sapiens
  Native (MAGC1_HUMAN)
SSPERTQSTFEGFAQSPLQIPV

SEQ ID NO: 253983 - protein, 23 aa, Homo sapiens
  Native (MAGC1_HUMAN)
SSPERTQSTFEGFAQSPLQIPVS

SEQ ID NO: 253984 - protein, 24 aa, Homo sapiens
  Native (MAGC1_HUMAN)
SSPERTQSTFEGFAQSPLQIPVSP

SEQ ID NO: 253985 - protein, 25 aa, Homo sapiens
  Native (MAGC1_HUMAN)
SSPERTQSTFEGFAQSPLQIPVSPS

SEQ ID NO: 253986 - protein, 15 aa, Homo sapiens
  Native (MAGC1_HUMAN)
SSPERTQSTFEGFPQ

SEQ ID NO: 253987 - protein, 16 aa, Homo sapiens
  Native (MAGC1_HUMAN)
SSPERTQSTFEGFPQS

SEQ ID NO: 253988 - protein, 17 aa, Homo sapiens
  Native (MAGC1_HUMAN)
SSPERTQSTFEGFPQSP

SEQ ID NO: 253989 - protein, 19 aa, Homo sapiens
  Native (MAGC1_HUMAN)
SSPERTQSTFEGFPQSPLQ

SEQ ID NO: 253990 - protein, 20 aa, Homo sapiens
  Native (MAGC1_HUMAN)
SSPERTQSTFEGFPQSPLQI

SEQ ID NO: 253991 - protein, 21 aa, Homo sapiens
  Native (MAGC1_HUMAN)
SSPERTQSTFEGFPQSPLQIP

SEQ ID NO: 253992 - protein, 22 aa, Homo sapiens
  Native (MAGC1_HUMAN)
SSPERTQSTFEGFPQSPLQIPV

SEQ ID NO: 253993 - protein, 23 aa, Homo sapiens
  Native (MAGC1_HUMAN)
SSPERTQSTFEGFPQSPLQIPVS

SEQ ID NO: 253994 - protein, 24 aa, Homo sapiens
  Native (MAGC1_HUMAN)
SSPERTQSTFEGFPQSPLQIPVSS

SEQ ID NO: 253995 - protein, 25 aa, Homo sapiens
  Native (MAGC1_HUMAN)
SSPERTQSTFEGFPQSPLQIPVSSS

SEQ ID NO: 253996 - protein, 19 aa, Homo sapiens
  Native (MAGC1_HUMAN)
SSPESAQSAFEGFPQSPLQ

SEQ ID NO: 253997 - protein, 20 aa, Homo sapiens
  Native (MAGC1_HUMAN)
SSPESAQSAFEGFPQSPLQI

SEQ ID NO: 253998 - protein, 21 aa, Homo sapiens
  Native (MAGC1_HUMAN)
SSPESAQSAFEGFPQSPLQIP

SEQ ID NO: 253999 - protein, 22 aa, Homo sapiens
  Native (MAGC1_HUMAN)
SSPESAQSAFEGFPQSPLQIPV

SEQ ID NO: 254000 - protein, 23 aa, Homo sapiens
  Native (MAGC1_HUMAN)
SSPESAQSAFEGFPQSPLQIPVS

SEQ ID NO: 254001 - protein, 24 aa, Homo sapiens
  Native (MAGC1_HUMAN)
SSPESAQSAFEGFPQSPLQIPVSS

SEQ ID NO: 254002 - protein, 25 aa, Homo sapiens
  Native (MAGC1_HUMAN)
SSPESAQSAFEGFPQSPLQIPVSSS

SEQ ID NO: 254003 - protein, 19 aa, Homo sapiens
  Native (MAGC1_HUMAN)
SSPESAQSTFEGFPQSPLQ

SEQ ID NO: 254004 - protein, 20 aa, Homo sapiens
  Native (MAGC1_HUMAN)
SSPESAQSTFEGFPQSPLQI

SEQ ID NO: 254005 - protein, 21 aa, Homo sapiens
  Native (MAGC1_HUMAN)
SSPESAQSTFEGFPQSPLQIP

SEQ ID NO: 254006 - protein, 22 aa, Homo sapiens
  Native (MAGC1_HUMAN)
SSPESAQSTFEGFPQSPLQIPG

SEQ ID NO: 254007 - protein, 23 aa, Homo sapiens
  Native (MAGC1_HUMAN)
SSPESAQSTFEGFPQSPLQIPGS

SEQ ID NO: 254008 - protein, 24 aa, Homo sapiens
  Native (MAGC1_HUMAN)
SSPESAQSTFEGFPQSPLQIPGSP

SEQ ID NO: 254009 - protein, 25 aa, Homo sapiens
  Native (MAGC1_HUMAN)
SSPESAQSTFEGFPQSPLQIPGSPS

SEQ ID NO: 254010 - protein, 19 aa, Homo sapiens
  Native (MAGC1_HUMAN)
SSPESDDTLYPLQSPQSRS

SEQ ID NO: 254011 - protein, 20 aa, Homo sapiens
  Native (MAGC1_HUMAN)
SSPESDDTLYPLQSPQSRSE

SEQ ID NO: 254012 - protein, 21 aa, Homo sapiens
  Native (MAGC1_HUMAN)
SSPESDDTLYPLQSPQSRSEG

SEQ ID NO: 254013 - protein, 22 aa, Homo sapiens
  Native (MAGC1_HUMAN)
SSPESDDTLYPLQSPQSRSEGE

SEQ ID NO: 254014 - protein, 23 aa, Homo sapiens
  Native (MAGC1_HUMAN)
SSPESDDTLYPLQSPQSRSEGED

SEQ ID NO: 254015 - protein, 24 aa, Homo sapiens
  Native (MAGC1_HUMAN)
SSPESDDTLYPLQSPQSRSEGEDS

SEQ ID NO: 254016 - protein, 25 aa, Homo sapiens
  Native (MAGC1_HUMAN)
SSPESDDTLYPLQSPQSRSEGEDSS

SEQ ID NO: 254017 - protein, 16 aa, Homo sapiens
  Native (MAGC1_HUMAN)
SSPESPLQSPVISFSS

SEQ ID NO: 254018 - protein, 17 aa, Homo sapiens
  Native (MAGC1_HUMAN)
SSPESPLQSPVISFSSS

SEQ ID NO: 254019 - protein, 19 aa, Homo sapiens
  Native (MAGC1_HUMAN)
SSPESPLQSPVISFSSSTS

SEQ ID NO: 254020 - protein, 20 aa, Homo sapiens
  Native (MAGC1_HUMAN)
SSPESPLQSPVISFSSSTSL

SEQ ID NO: 254021 - protein, 21 aa, Homo sapiens
  Native (MAGC1_HUMAN)
SSPESPLQSPVISFSSSTSLS

SEQ ID NO: 254022 - protein, 22 aa, Homo sapiens
  Native (MAGC1_HUMAN)
SSPESPLQSPVISFSSSTSLSP

SEQ ID NO: 254023 - protein, 23 aa, Homo sapiens
  Native (MAGC1_HUMAN)
SSPESPLQSPVISFSSSTSLSPF

SEQ ID NO: 254024 - protein, 24 aa, Homo sapiens
  Native (MAGC1_HUMAN)
SSPESPLQSPVISFSSSTSLSPFS

SEQ ID NO: 254025 - protein, 25 aa, Homo sapiens
  Native (MAGC1_HUMAN)
SSPESPLQSPVISFSSSTSLSPFSE

SEQ ID NO: 254026 - protein, 20 aa, Homo sapiens
  Native (MAGC1_HUMAN)
SSPESTQSPFEGFPQSPLQI

SEQ ID NO: 254027 - protein, 21 aa, Homo sapiens
  Native (MAGC1_HUMAN)
SSPESTQSPFEGFPQSPLQIP

SEQ ID NO: 254028 - protein, 22 aa, Homo sapiens
  Native (MAGC1_HUMAN)
SSPESTQSPFEGFPQSPLQIPV

SEQ ID NO: 254029 - protein, 23 aa, Homo sapiens
  Native (MAGC1_HUMAN)
SSPESTQSPFEGFPQSPLQIPVS

SEQ ID NO: 254030 - protein, 24 aa, Homo sapiens
  Native (MAGC1_HUMAN)
SSPESTQSPFEGFPQSPLQIPVSR

SEQ ID NO: 254031 - protein, 25 aa, Homo sapiens
  Native (MAGC1_HUMAN)
SSPESTQSPFEGFPQSPLQIPVSRS

SEQ ID NO: 254032 - protein, 19 aa, Homo sapiens
  Native (MAGC1_HUMAN)
SSPESTQSPFEGFPQSVLQ

SEQ ID NO: 254033 - protein, 20 aa, Homo sapiens
  Native (MAGC1_HUMAN)
SSPESTQSPFEGFPQSVLQI

SEQ ID NO: 254034 - protein, 21 aa, Homo sapiens
  Native (MAGC1_HUMAN)
SSPESTQSPFEGFPQSVLQIP

SEQ ID NO: 254035 - protein, 22 aa, Homo sapiens
  Native (MAGC1_HUMAN)
SSPESTQSPFEGFPQSVLQIPV

SEQ ID NO: 254036 - protein, 23 aa, Homo sapiens
  Native (MAGC1_HUMAN)
SSPESTQSPFEGFPQSVLQIPVS

SEQ ID NO: 254037 - protein, 24 aa, Homo sapiens
  Native (MAGC1_HUMAN)
SSPESTQSPFEGFPQSVLQIPVSA

SEQ ID NO: 254038 - protein, 25 aa, Homo sapiens
  Native (MAGC1_HUMAN)
SSPESTQSPFEGFPQSVLQIPVSAA

SEQ ID NO: 254039 - protein, 14 aa, Homo sapiens
  Native (MAGC1_HUMAN)
SSPPRYEFLWGPRA

SEQ ID NO: 254040 - protein, 15 aa, Homo sapiens
  Native (MAGC1_HUMAN)
SSPPRYEFLWGPRAH

SEQ ID NO: 254041 - protein, 16 aa, Homo sapiens
  Native (MAGC1_HUMAN)
SSPPRYEFLWGPRAHS

SEQ ID NO: 254042 - protein, 17 aa, Homo sapiens
  Native (MAGC1_HUMAN)
SSPPRYEFLWGPRAHSE

SEQ ID NO: 254043 - protein, 18 aa, Homo sapiens
  Native (MAGC1_HUMAN)
SSPPRYEFLWGPRAHSEV

SEQ ID NO: 254044 - protein, 19 aa, Homo sapiens
  Native (MAGC1_HUMAN)
SSPPRYEFLWGPRAHSEVI

SEQ ID NO: 254045 - protein, 20 aa, Homo sapiens
  Native (MAGC1_HUMAN)
SSPPRYEFLWGPRAHSEVIK

SEQ ID NO: 254046 - protein, 21 aa, Homo sapiens
  Native (MAGC1_HUMAN)
SSPPRYEFLWGPRAHSEVIKR

SEQ ID NO: 254047 - protein, 22 aa, Homo sapiens
  Native (MAGC1_HUMAN)
SSPPRYEFLWGPRAHSEVIKRK

SEQ ID NO: 254048 - protein, 23 aa, Homo sapiens
  Native (MAGC1_HUMAN)
SSPPRYEFLWGPRAHSEVIKRKV

SEQ ID NO: 254049 - protein, 24 aa, Homo sapiens
  Native (MAGC1_HUMAN)
SSPPRYEFLWGPRAHSEVIKRKVV

SEQ ID NO: 254050 - protein, 25 aa, Homo sapiens
  Native (MAGC1_HUMAN)
SSPPRYEFLWGPRAHSEVIKRKVVE

SEQ ID NO: 254051 - protein, 19 aa, Homo sapiens
  Native (MAGC1_HUMAN)
SSPVDEYTSSSDTLLESDS

SEQ ID NO: 254052 - protein, 20 aa, Homo sapiens
  Native (MAGC1_HUMAN)
SSPVDEYTSSSDTLLESDSL

SEQ ID NO: 254053 - protein, 21 aa, Homo sapiens
  Native (MAGC1_HUMAN)
SSPVDEYTSSSDTLLESDSLT

SEQ ID NO: 254054 - protein, 22 aa, Homo sapiens
  Native (MAGC1_HUMAN)
SSPVDEYTSSSDTLLESDSLTD

SEQ ID NO: 254055 - protein, 23 aa, Homo sapiens
  Native (MAGC1_HUMAN)
SSPVDEYTSSSDTLLESDSLTDS

SEQ ID NO: 254056 - protein, 24 aa, Homo sapiens
  Native (MAGC1_HUMAN)
SSPVDEYTSSSDTLLESDSLTDSE

SEQ ID NO: 254057 - protein, 25 aa, Homo sapiens
  Native (MAGC1_HUMAN)
SSPVDEYTSSSDTLLESDSLTDSES

SEQ ID NO: 254058 - protein, 14 aa, Homo sapiens
  Native (MAGC1_HUMAN)
SSPVSSFPSSTSSS

SEQ ID NO: 254059 - protein, 15 aa, Homo sapiens
  Native (MAGC1_HUMAN)
SSPVSSFPSSTSSSL

SEQ ID NO: 254060 - protein, 16 aa, Homo sapiens
  Native (MAGC1_HUMAN)
SSPVSSFPSSTSSSLS

SEQ ID NO: 254061 - protein, 17 aa, Homo sapiens
  Native (MAGC1_HUMAN)
SSPVSSFPSSTSSSLSK

SEQ ID NO: 254062 - protein, 18 aa, Homo sapiens
  Native (MAGC1_HUMAN)
SSPVSSFPSSTSSSLSKS

SEQ ID NO: 254063 - protein, 19 aa, Homo sapiens
  Native (MAGC1_HUMAN)
SSPVSSFPSSTSSSLSKSS

SEQ ID NO: 254064 - protein, 20 aa, Homo sapiens
  Native (MAGC1_HUMAN)
SSPVSSFPSSTSSSLSKSSP

SEQ ID NO: 254065 - protein, 21 aa, Homo sapiens
  Native (MAGC1_HUMAN)
SSPVSSFPSSTSSSLSKSSPE

SEQ ID NO: 254066 - protein, 22 aa, Homo sapiens
  Native (MAGC1_HUMAN)
SSPVSSFPSSTSSSLSKSSPES

SEQ ID NO: 254067 - protein, 23 aa, Homo sapiens
  Native (MAGC1_HUMAN)
SSPVSSFPSSTSSSLSKSSPESP

SEQ ID NO: 254068 - protein, 24 aa, Homo sapiens
  Native (MAGC1_HUMAN)
SSPVSSFPSSTSSSLSKSSPESPL

SEQ ID NO: 254069 - protein, 25 aa, Homo sapiens
  Native (MAGC1_HUMAN)
SSPVSSFPSSTSSSLSKSSPESPLQ

SEQ ID NO: 254070 - protein, 13 aa, Homo sapiens
  Native (MAGC1_HUMAN)
SSSFSYTLLSLFQ

SEQ ID NO: 254071 - protein, 14 aa, Homo sapiens
  Native (MAGC1_HUMAN)
SSSFSYTLLSLFQS

SEQ ID NO: 254072 - protein, 15 aa, Homo sapiens
  Native (MAGC1_HUMAN)
SSSFSYTLLSLFQSS

SEQ ID NO: 254073 - protein, 16 aa, Homo sapiens
  Native (MAGC1_HUMAN)
SSSFSYTLLSLFQSSP

SEQ ID NO: 254074 - protein, 17 aa, Homo sapiens
  Native (MAGC1_HUMAN)
SSSFSYTLLSLFQSSPE

SEQ ID NO: 254075 - protein, 18 aa, Homo sapiens
  Native (MAGC1_HUMAN)
SSSFSYTLLSLFQSSPER

SEQ ID NO: 254076 - protein, 19 aa, Homo sapiens
  Native (MAGC1_HUMAN)
SSSFSYTLLSLFQSSPERT

SEQ ID NO: 254077 - protein, 20 aa, Homo sapiens
  Native (MAGC1_HUMAN)
SSSFSYTLLSLFQSSPERTH

SEQ ID NO: 254078 - protein, 21 aa, Homo sapiens
  Native (MAGC1_HUMAN)
SSSFSYTLLSLFQSSPERTHS

SEQ ID NO: 254079 - protein, 22 aa, Homo sapiens
  Native (MAGC1_HUMAN)
SSSFSYTLLSLFQSSPERTHST

SEQ ID NO: 254080 - protein, 23 aa, Homo sapiens
  Native (MAGC1_HUMAN)
SSSFSYTLLSLFQSSPERTHSTF

SEQ ID NO: 254081 - protein, 24 aa, Homo sapiens
  Native (MAGC1_HUMAN)
SSSFSYTLLSLFQSSPERTHSTFE

SEQ ID NO: 254082 - protein, 25 aa, Homo sapiens
  Native (MAGC1_HUMAN)
SSSFSYTLLSLFQSSPERTHSTFEG

SEQ ID NO: 254083 - protein, 25 aa, Homo sapiens
  Native (MAGC1_HUMAN)
SSSLSKSSPESPLQSPVISFSSSTS

SEQ ID NO: 254084 - protein, 13 aa, Homo sapiens
  Native (MAGC1_HUMAN)
SSSLSQSSPVSSF

SEQ ID NO: 254085 - protein, 14 aa, Homo sapiens
  Native (MAGC1_HUMAN)
SSSLSQSSPVSSFP

SEQ ID NO: 254086 - protein, 15 aa, Homo sapiens
  Native (MAGC1_HUMAN)
SSSLSQSSPVSSFPS

SEQ ID NO: 254087 - protein, 16 aa, Homo sapiens
  Native (MAGC1_HUMAN)
SSSLSQSSPVSSFPSS

SEQ ID NO: 254088 - protein, 17 aa, Homo sapiens
  Native (MAGC1_HUMAN)
SSSLSQSSPVSSFPSST

SEQ ID NO: 254089 - protein, 18 aa, Homo sapiens
  Native (MAGC1_HUMAN)
SSSLSQSSPVSSFPSSTS

SEQ ID NO: 254090 - protein, 19 aa, Homo sapiens
  Native (MAGC1_HUMAN)
SSSLSQSSPVSSFPSSTSS

SEQ ID NO: 254091 - protein, 20 aa, Homo sapiens
  Native (MAGC1_HUMAN)
SSSLSQSSPVSSFPSSTSSS

SEQ ID NO: 254092 - protein, 21 aa, Homo sapiens
  Native (MAGC1_HUMAN)
SSSLSQSSPVSSFPSSTSSSL

SEQ ID NO: 254093 - protein, 22 aa, Homo sapiens
  Native (MAGC1_HUMAN)
SSSLSQSSPVSSFPSSTSSSLS

SEQ ID NO: 254094 - protein, 23 aa, Homo sapiens
  Native (MAGC1_HUMAN)
SSSLSQSSPVSSFPSSTSSSLSK

SEQ ID NO: 254095 - protein, 24 aa, Homo sapiens
  Native (MAGC1_HUMAN)
SSSLSQSSPVSSFPSSTSSSLSKS

SEQ ID NO: 254096 - protein, 25 aa, Homo sapiens
  Native (MAGC1_HUMAN)
SSSLSQSSPVSSFPSSTSSSLSKSS

SEQ ID NO: 254097 - protein, 19 aa, Homo sapiens
  Native (MAGC1_HUMAN)
SSSPVDEYTSSSDTLLESD

SEQ ID NO: 254098 - protein, 20 aa, Homo sapiens
  Native (MAGC1_HUMAN)
SSSPVDEYTSSSDTLLESDS

SEQ ID NO: 254099 - protein, 21 aa, Homo sapiens
  Native (MAGC1_HUMAN)
SSSPVDEYTSSSDTLLESDSL

SEQ ID NO: 254100 - protein, 22 aa, Homo sapiens
  Native (MAGC1_HUMAN)
SSSPVDEYTSSSDTLLESDSLT

SEQ ID NO: 254101 - protein, 23 aa, Homo sapiens
  Native (MAGC1_HUMAN)
SSSPVDEYTSSSDTLLESDSLTD

SEQ ID NO: 254102 - protein, 24 aa, Homo sapiens
  Native (MAGC1_HUMAN)
SSSPVDEYTSSSDTLLESDSLTDS

SEQ ID NO: 254103 - protein, 25 aa, Homo sapiens
  Native (MAGC1_HUMAN)
SSSPVDEYTSSSDTLLESDSLTDSE

SEQ ID NO: 254104 - protein, 14 aa, Homo sapiens
  Native (MAGC1_HUMAN)
SSSSSSSTLLSLFQ

SEQ ID NO: 254105 - protein, 15 aa, Homo sapiens
  Native (MAGC1_HUMAN)
SSSSSSSTLLSLFQS

SEQ ID NO: 254106 - protein, 16 aa, Homo sapiens
  Native (MAGC1_HUMAN)
SSSSSSSTLLSLFQSS

SEQ ID NO: 254107 - protein, 17 aa, Homo sapiens
  Native (MAGC1_HUMAN)
SSSSSSSTLLSLFQSSP

SEQ ID NO: 254108 - protein, 18 aa, Homo sapiens
  Native (MAGC1_HUMAN)
SSSSSSSTLLSLFQSSPE

SEQ ID NO: 254109 - protein, 19 aa, Homo sapiens
  Native (MAGC1_HUMAN)
SSSSSSSTLLSLFQSSPEC

SEQ ID NO: 254110 - protein, 20 aa, Homo sapiens
  Native (MAGC1_HUMAN)
SSSSSSSTLLSLFQSSPECT

SEQ ID NO: 254111 - protein, 21 aa, Homo sapiens
  Native (MAGC1_HUMAN)
SSSSSSSTLLSLFQSSPECTQ

SEQ ID NO: 254112 - protein, 22 aa, Homo sapiens
  Native (MAGC1_HUMAN)
SSSSSSSTLLSLFQSSPECTQS

SEQ ID NO: 254113 - protein, 23 aa, Homo sapiens
  Native (MAGC1_HUMAN)
SSSSSSSTLLSLFQSSPECTQST

SEQ ID NO: 254114 - protein, 24 aa, Homo sapiens
  Native (MAGC1_HUMAN)
SSSSSSSTLLSLFQSSPECTQSTF

SEQ ID NO: 254115 - protein, 25 aa, Homo sapiens
  Native (MAGC1_HUMAN)
SSSSSSSTLLSLFQSSPECTQSTFE

SEQ ID NO: 254116 - protein, 14 aa, Homo sapiens
  Native (MAGC1_HUMAN)
SSSSSSTLLSLFQS

SEQ ID NO: 254117 - protein, 15 aa, Homo sapiens
  Native (MAGC1_HUMAN)
SSSSSSTLLSLFQSS

SEQ ID NO: 254118 - protein, 16 aa, Homo sapiens
  Native (MAGC1_HUMAN)
SSSSSSTLLSLFQSSP

SEQ ID NO: 254119 - protein, 17 aa, Homo sapiens
  Native (MAGC1_HUMAN)
SSSSSSTLLSLFQSSPE

SEQ ID NO: 254120 - protein, 18 aa, Homo sapiens
  Native (MAGC1_HUMAN)
SSSSSSTLLSLFQSSPEC

SEQ ID NO: 254121 - protein, 19 aa, Homo sapiens
  Native (MAGC1_HUMAN)
SSSSSSTLLSLFQSSPECT

SEQ ID NO: 254122 - protein, 20 aa, Homo sapiens
  Native (MAGC1_HUMAN)
SSSSSSTLLSLFQSSPECTQ

SEQ ID NO: 254123 - protein, 21 aa, Homo sapiens
  Native (MAGC1_HUMAN)
SSSSSSTLLSLFQSSPECTQS

SEQ ID NO: 254124 - protein, 22 aa, Homo sapiens
  Native (MAGC1_HUMAN)
SSSSSSTLLSLFQSSPECTQST

SEQ ID NO: 254125 - protein, 23 aa, Homo sapiens
  Native (MAGC1_HUMAN)
SSSSSSTLLSLFQSSPECTQSTF

SEQ ID NO: 254126 - protein, 24 aa, Homo sapiens
  Native (MAGC1_HUMAN)
SSSSSSTLLSLFQSSPECTQSTFE

SEQ ID NO: 254127 - protein, 25 aa, Homo sapiens
  Native (MAGC1_HUMAN)
SSSSSSTLLSLFQSSPECTQSTFEG

SEQ ID NO: 254128 - protein, 18 aa, Homo sapiens
  Native (MAGC1_HUMAN)
SSSSSSTLLSLFQSSPER

SEQ ID NO: 254129 - protein, 19 aa, Homo sapiens
  Native (MAGC1_HUMAN)
SSSSSSTLLSLFQSSPERT

SEQ ID NO: 254130 - protein, 20 aa, Homo sapiens
  Native (MAGC1_HUMAN)
SSSSSSTLLSLFQSSPERTH

SEQ ID NO: 254131 - protein, 21 aa, Homo sapiens
  Native (MAGC1_HUMAN)
SSSSSSTLLSLFQSSPERTHS

SEQ ID NO: 254132 - protein, 22 aa, Homo sapiens
  Native (MAGC1_HUMAN)
SSSSSSTLLSLFQSSPERTHST

SEQ ID NO: 254133 - protein, 23 aa, Homo sapiens
  Native (MAGC1_HUMAN)
SSSSSSTLLSLFQSSPERTHSTF

SEQ ID NO: 254134 - protein, 24 aa, Homo sapiens
  Native (MAGC1_HUMAN)
SSSSSSTLLSLFQSSPERTHSTFE

SEQ ID NO: 254135 - protein, 25 aa, Homo sapiens
  Native (MAGC1_HUMAN)
SSSSSSTLLSLFQSSPERTHSTFEG

SEQ ID NO: 254136 - protein, 14 aa, Homo sapiens
  Native (MAGC1_HUMAN)
SSSSSTLLSLFQSS

SEQ ID NO: 254137 - protein, 15 aa, Homo sapiens
  Native (MAGC1_HUMAN)
SSSSSTLLSLFQSSP

SEQ ID NO: 254138 - protein, 16 aa, Homo sapiens
  Native (MAGC1_HUMAN)
SSSSSTLLSLFQSSPE

SEQ ID NO: 254139 - protein, 17 aa, Homo sapiens
  Native (MAGC1_HUMAN)
SSSSSTLLSLFQSSPEC

SEQ ID NO: 254140 - protein, 18 aa, Homo sapiens
  Native (MAGC1_HUMAN)
SSSSSTLLSLFQSSPECT

SEQ ID NO: 254141 - protein, 19 aa, Homo sapiens
  Native (MAGC1_HUMAN)
SSSSSTLLSLFQSSPECTQ

SEQ ID NO: 254142 - protein, 20 aa, Homo sapiens
  Native (MAGC1_HUMAN)
SSSSSTLLSLFQSSPECTQS

SEQ ID NO: 254143 - protein, 21 aa, Homo sapiens
  Native (MAGC1_HUMAN)
SSSSSTLLSLFQSSPECTQST

SEQ ID NO: 254144 - protein, 22 aa, Homo sapiens
  Native (MAGC1_HUMAN)
SSSSSTLLSLFQSSPECTQSTF

SEQ ID NO: 254145 - protein, 23 aa, Homo sapiens
  Native (MAGC1_HUMAN)
SSSSSTLLSLFQSSPECTQSTFE

SEQ ID NO: 254146 - protein, 24 aa, Homo sapiens
  Native (MAGC1_HUMAN)
SSSSSTLLSLFQSSPECTQSTFEG

SEQ ID NO: 254147 - protein, 25 aa, Homo sapiens
  Native (MAGC1_HUMAN)
SSSSSTLLSLFQSSPECTQSTFEGF

SEQ ID NO: 254148 - protein, 17 aa, Homo sapiens
  Native (MAGC1_HUMAN)
SSSSSTLLSLFQSSPER

SEQ ID NO: 254149 - protein, 18 aa, Homo sapiens
  Native (MAGC1_HUMAN)
SSSSSTLLSLFQSSPERT

SEQ ID NO: 254150 - protein, 19 aa, Homo sapiens
  Native (MAGC1_HUMAN)
SSSSSTLLSLFQSSPERTH

SEQ ID NO: 254151 - protein, 20 aa, Homo sapiens
  Native (MAGC1_HUMAN)
SSSSSTLLSLFQSSPERTHS

SEQ ID NO: 254152 - protein, 21 aa, Homo sapiens
  Native (MAGC1_HUMAN)
SSSSSTLLSLFQSSPERTHST

SEQ ID NO: 254153 - protein, 22 aa, Homo sapiens
  Native (MAGC1_HUMAN)
SSSSSTLLSLFQSSPERTHSTF

SEQ ID NO: 254154 - protein, 23 aa, Homo sapiens
  Native (MAGC1_HUMAN)
SSSSSTLLSLFQSSPERTHSTFE

SEQ ID NO: 254155 - protein, 24 aa, Homo sapiens
  Native (MAGC1_HUMAN)
SSSSSTLLSLFQSSPERTHSTFEG

SEQ ID NO: 254156 - protein, 25 aa, Homo sapiens
  Native (MAGC1_HUMAN)
SSSSSTLLSLFQSSPERTHSTFEGF

SEQ ID NO: 254157 - protein, 13 aa, Homo sapiens
  Native (MAGC1_HUMAN)
SSSSTLLSLFQSF

SEQ ID NO: 254158 - protein, 14 aa, Homo sapiens
  Native (MAGC1_HUMAN)
SSSSTLLSLFQSFS

SEQ ID NO: 254159 - protein, 15 aa, Homo sapiens
  Native (MAGC1_HUMAN)
SSSSTLLSLFQSFSE

SEQ ID NO: 254160 - protein, 16 aa, Homo sapiens
  Native (MAGC1_HUMAN)
SSSSTLLSLFQSFSER

SEQ ID NO: 254161 - protein, 17 aa, Homo sapiens
  Native (MAGC1_HUMAN)
SSSSTLLSLFQSFSERT

SEQ ID NO: 254162 - protein, 18 aa, Homo sapiens
  Native (MAGC1_HUMAN)
SSSSTLLSLFQSFSERTQ

SEQ ID NO: 254163 - protein, 19 aa, Homo sapiens
  Native (MAGC1_HUMAN)
SSSSTLLSLFQSFSERTQS

SEQ ID NO: 254164 - protein, 20 aa, Homo sapiens
  Native (MAGC1_HUMAN)
SSSSTLLSLFQSFSERTQST

SEQ ID NO: 254165 - protein, 21 aa, Homo sapiens
  Native (MAGC1_HUMAN)
SSSSTLLSLFQSFSERTQSTF

SEQ ID NO: 254166 - protein, 22 aa, Homo sapiens
  Native (MAGC1_HUMAN)
SSSSTLLSLFQSFSERTQSTFE

SEQ ID NO: 254167 - protein, 23 aa, Homo sapiens
  Native (MAGC1_HUMAN)
SSSSTLLSLFQSFSERTQSTFEG

SEQ ID NO: 254168 - protein, 24 aa, Homo sapiens
  Native (MAGC1_HUMAN)
SSSSTLLSLFQSFSERTQSTFEGF

SEQ ID NO: 254169 - protein, 25 aa, Homo sapiens
  Native (MAGC1_HUMAN)
SSSSTLLSLFQSFSERTQSTFEGFA

SEQ ID NO: 254170 - protein, 13 aa, Homo sapiens
  Native (MAGC1_HUMAN)
SSSSTLLSLFQSS

SEQ ID NO: 254171 - protein, 14 aa, Homo sapiens
  Native (MAGC1_HUMAN)
SSSSTLLSLFQSSP

SEQ ID NO: 254172 - protein, 15 aa, Homo sapiens
  Native (MAGC1_HUMAN)
SSSSTLLSLFQSSPE

SEQ ID NO: 254173 - protein, 16 aa, Homo sapiens
  Native (MAGC1_HUMAN)
SSSSTLLSLFQSSPEC

SEQ ID NO: 254174 - protein, 17 aa, Homo sapiens
  Native (MAGC1_HUMAN)
SSSSTLLSLFQSSPECT

SEQ ID NO: 254175 - protein, 18 aa, Homo sapiens
  Native (MAGC1_HUMAN)
SSSSTLLSLFQSSPECTQ

SEQ ID NO: 254176 - protein, 19 aa, Homo sapiens
  Native (MAGC1_HUMAN)
SSSSTLLSLFQSSPECTQS

SEQ ID NO: 254177 - protein, 20 aa, Homo sapiens
  Native (MAGC1_HUMAN)
SSSSTLLSLFQSSPECTQST

SEQ ID NO: 254178 - protein, 21 aa, Homo sapiens
  Native (MAGC1_HUMAN)
SSSSTLLSLFQSSPECTQSTF

SEQ ID NO: 254179 - protein, 22 aa, Homo sapiens
  Native (MAGC1_HUMAN)
SSSSTLLSLFQSSPECTQSTFE

SEQ ID NO: 254180 - protein, 23 aa, Homo sapiens
  Native (MAGC1_HUMAN)
SSSSTLLSLFQSSPECTQSTFEG

SEQ ID NO: 254181 - protein, 24 aa, Homo sapiens
  Native (MAGC1_HUMAN)
SSSSTLLSLFQSSPECTQSTFEGF

SEQ ID NO: 254182 - protein, 25 aa, Homo sapiens
  Native (MAGC1_HUMAN)
SSSSTLLSLFQSSPECTQSTFEGFP

SEQ ID NO: 254183 - protein, 16 aa, Homo sapiens
  Native (MAGC1_HUMAN)
SSSSTLLSLFQSSPER

SEQ ID NO: 254184 - protein, 17 aa, Homo sapiens
  Native (MAGC1_HUMAN)
SSSSTLLSLFQSSPERT

SEQ ID NO: 254185 - protein, 18 aa, Homo sapiens
  Native (MAGC1_HUMAN)
SSSSTLLSLFQSSPERTH

SEQ ID NO: 254186 - protein, 19 aa, Homo sapiens
  Native (MAGC1_HUMAN)
SSSSTLLSLFQSSPERTHS

SEQ ID NO: 254187 - protein, 20 aa, Homo sapiens
  Native (MAGC1_HUMAN)
SSSSTLLSLFQSSPERTHST

SEQ ID NO: 254188 - protein, 21 aa, Homo sapiens
  Native (MAGC1_HUMAN)
SSSSTLLSLFQSSPERTHSTF

SEQ ID NO: 254189 - protein, 22 aa, Homo sapiens
  Native (MAGC1_HUMAN)
SSSSTLLSLFQSSPERTHSTFE

SEQ ID NO: 254190 - protein, 23 aa, Homo sapiens
  Native (MAGC1_HUMAN)
SSSSTLLSLFQSSPERTHSTFEG

SEQ ID NO: 254191 - protein, 24 aa, Homo sapiens
  Native (MAGC1_HUMAN)
SSSSTLLSLFQSSPERTHSTFEGF

SEQ ID NO: 254192 - protein, 25 aa, Homo sapiens
  Native (MAGC1_HUMAN)
SSSSTLLSLFQSSPERTHSTFEGFP

SEQ ID NO: 254193 - protein, 13 aa, Homo sapiens
  Native (MAGC1_HUMAN)
SSSTLLSLFQSFS

SEQ ID NO: 254194 - protein, 14 aa, Homo sapiens
  Native (MAGC1_HUMAN)
SSSTLLSLFQSFSE

SEQ ID NO: 254195 - protein, 15 aa, Homo sapiens
  Native (MAGC1_HUMAN)
SSSTLLSLFQSFSER

SEQ ID NO: 254196 - protein, 16 aa, Homo sapiens
  Native (MAGC1_HUMAN)
SSSTLLSLFQSFSERT

SEQ ID NO: 254197 - protein, 17 aa, Homo sapiens
  Native (MAGC1_HUMAN)
SSSTLLSLFQSFSERTQ

SEQ ID NO: 254198 - protein, 18 aa, Homo sapiens
  Native (MAGC1_HUMAN)
SSSTLLSLFQSFSERTQS

SEQ ID NO: 254199 - protein, 19 aa, Homo sapiens
  Native (MAGC1_HUMAN)
SSSTLLSLFQSFSERTQST

SEQ ID NO: 254200 - protein, 20 aa, Homo sapiens
  Native (MAGC1_HUMAN)
SSSTLLSLFQSFSERTQSTF

SEQ ID NO: 254201 - protein, 21 aa, Homo sapiens
  Native (MAGC1_HUMAN)
SSSTLLSLFQSFSERTQSTFE

SEQ ID NO: 254202 - protein, 22 aa, Homo sapiens
  Native (MAGC1_HUMAN)
SSSTLLSLFQSFSERTQSTFEG

SEQ ID NO: 254203 - protein, 23 aa, Homo sapiens
  Native (MAGC1_HUMAN)
SSSTLLSLFQSFSERTQSTFEGF

SEQ ID NO: 254204 - protein, 24 aa, Homo sapiens
  Native (MAGC1_HUMAN)
SSSTLLSLFQSFSERTQSTFEGFA

SEQ ID NO: 254205 - protein, 25 aa, Homo sapiens
  Native (MAGC1_HUMAN)
SSSTLLSLFQSFSERTQSTFEGFAQ

SEQ ID NO: 254206 - protein, 13 aa, Homo sapiens
  Native (MAGC1_HUMAN)
SSSTLLSLFQSSP

SEQ ID NO: 254207 - protein, 14 aa, Homo sapiens
  Native (MAGC1_HUMAN)
SSSTLLSLFQSSPE

SEQ ID NO: 254208 - protein, 15 aa, Homo sapiens
  Native (MAGC1_HUMAN)
SSSTLLSLFQSSPEC

SEQ ID NO: 254209 - protein, 16 aa, Homo sapiens
  Native (MAGC1_HUMAN)
SSSTLLSLFQSSPECT

SEQ ID NO: 254210 - protein, 17 aa, Homo sapiens
  Native (MAGC1_HUMAN)
SSSTLLSLFQSSPECTQ

SEQ ID NO: 254211 - protein, 18 aa, Homo sapiens
  Native (MAGC1_HUMAN)
SSSTLLSLFQSSPECTQS

SEQ ID NO: 254212 - protein, 19 aa, Homo sapiens
  Native (MAGC1_HUMAN)
SSSTLLSLFQSSPECTQST

SEQ ID NO: 254213 - protein, 20 aa, Homo sapiens
  Native (MAGC1_HUMAN)
SSSTLLSLFQSSPECTQSTF

SEQ ID NO: 254214 - protein, 21 aa, Homo sapiens
  Native (MAGC1_HUMAN)
SSSTLLSLFQSSPECTQSTFE

SEQ ID NO: 254215 - protein, 22 aa, Homo sapiens
  Native (MAGC1_HUMAN)
SSSTLLSLFQSSPECTQSTFEG

SEQ ID NO: 254216 - protein, 23 aa, Homo sapiens
  Native (MAGC1_HUMAN)
SSSTLLSLFQSSPECTQSTFEGF

SEQ ID NO: 254217 - protein, 24 aa, Homo sapiens
  Native (MAGC1_HUMAN)
SSSTLLSLFQSSPECTQSTFEGFP

SEQ ID NO: 254218 - protein, 25 aa, Homo sapiens
  Native (MAGC1_HUMAN)
SSSTLLSLFQSSPECTQSTFEGFPQ

SEQ ID NO: 254219 - protein, 15 aa, Homo sapiens
  Native (MAGC1_HUMAN)
SSSTLLSLFQSSPER

SEQ ID NO: 254220 - protein, 16 aa, Homo sapiens
  Native (MAGC1_HUMAN)
SSSTLLSLFQSSPERT

SEQ ID NO: 254221 - protein, 17 aa, Homo sapiens
  Native (MAGC1_HUMAN)
SSSTLLSLFQSSPERTH

SEQ ID NO: 254222 - protein, 18 aa, Homo sapiens
  Native (MAGC1_HUMAN)
SSSTLLSLFQSSPERTHS

SEQ ID NO: 254223 - protein, 19 aa, Homo sapiens
  Native (MAGC1_HUMAN)
SSSTLLSLFQSSPERTHST

SEQ ID NO: 254224 - protein, 20 aa, Homo sapiens
  Native (MAGC1_HUMAN)
SSSTLLSLFQSSPERTHSTF

SEQ ID NO: 254225 - protein, 21 aa, Homo sapiens
  Native (MAGC1_HUMAN)
SSSTLLSLFQSSPERTHSTFE

SEQ ID NO: 254226 - protein, 22 aa, Homo sapiens
  Native (MAGC1_HUMAN)
SSSTLLSLFQSSPERTHSTFEG

SEQ ID NO: 254227 - protein, 23 aa, Homo sapiens
  Native (MAGC1_HUMAN)
SSSTLLSLFQSSPERTHSTFEGF

SEQ ID NO: 254228 - protein, 24 aa, Homo sapiens
  Native (MAGC1_HUMAN)
SSSTLLSLFQSSPERTHSTFEGFP

SEQ ID NO: 254229 - protein, 25 aa, Homo sapiens
  Native (MAGC1_HUMAN)
SSSTLLSLFQSSPERTHSTFEGFPQ

SEQ ID NO: 254230 - protein, 13 aa, Homo sapiens
  Native (MAGC1_HUMAN)
SSSTLVSIFQSSP

SEQ ID NO: 254231 - protein, 14 aa, Homo sapiens
  Native (MAGC1_HUMAN)
SSSTLVSIFQSSPE

SEQ ID NO: 254232 - protein, 15 aa, Homo sapiens
  Native (MAGC1_HUMAN)
SSSTLVSIFQSSPES

SEQ ID NO: 254233 - protein, 16 aa, Homo sapiens
  Native (MAGC1_HUMAN)
SSSTLVSIFQSSPEST

SEQ ID NO: 254234 - protein, 17 aa, Homo sapiens
  Native (MAGC1_HUMAN)
SSSTLVSIFQSSPESTQ

SEQ ID NO: 254235 - protein, 18 aa, Homo sapiens
  Native (MAGC1_HUMAN)
SSSTLVSIFQSSPESTQS

SEQ ID NO: 254236 - protein, 19 aa, Homo sapiens
  Native (MAGC1_HUMAN)
SSSTLVSIFQSSPESTQSP

SEQ ID NO: 254237 - protein, 20 aa, Homo sapiens
  Native (MAGC1_HUMAN)
SSSTLVSIFQSSPESTQSPF

SEQ ID NO: 254238 - protein, 21 aa, Homo sapiens
  Native (MAGC1_HUMAN)
SSSTLVSIFQSSPESTQSPFE

SEQ ID NO: 254239 - protein, 22 aa, Homo sapiens
  Native (MAGC1_HUMAN)
SSSTLVSIFQSSPESTQSPFEG

SEQ ID NO: 254240 - protein, 23 aa, Homo sapiens
  Native (MAGC1_HUMAN)
SSSTLVSIFQSSPESTQSPFEGF

SEQ ID NO: 254241 - protein, 24 aa, Homo sapiens
  Native (MAGC1_HUMAN)
SSSTLVSIFQSSPESTQSPFEGFP

SEQ ID NO: 254242 - protein, 25 aa, Homo sapiens
  Native (MAGC1_HUMAN)
SSSTLVSIFQSSPESTQSPFEGFPQ

SEQ ID NO: 254243 - protein, 14 aa, Homo sapiens
  Native (MAGC1_HUMAN)
SSSTSLSLPQSFPE

SEQ ID NO: 254244 - protein, 15 aa, Homo sapiens
  Native (MAGC1_HUMAN)
SSSTSLSLPQSFPES

SEQ ID NO: 254245 - protein, 16 aa, Homo sapiens
  Native (MAGC1_HUMAN)
SSSTSLSLPQSFPESP

SEQ ID NO: 254246 - protein, 17 aa, Homo sapiens
  Native (MAGC1_HUMAN)
SSSTSLSLPQSFPESPQ

SEQ ID NO: 254247 - protein, 20 aa, Homo sapiens
  Native (MAGC1_HUMAN)
SSSTSLSLPQSFPESPQSPP

SEQ ID NO: 254248 - protein, 15 aa, Homo sapiens
  Native (MAGC1_HUMAN)
SSSTSLSPFSEESSS

SEQ ID NO: 254249 - protein, 20 aa, Homo sapiens
  Native (MAGC1_HUMAN)
SSSTSLSPFSEESSSPVDEY

SEQ ID NO: 254250 - protein, 13 aa, Homo sapiens
  Native (MAGC1_HUMAN)
SSTLLSIFQSSPE

SEQ ID NO: 254251 - protein, 14 aa, Homo sapiens
  Native (MAGC1_HUMAN)
SSTLLSIFQSSPER

SEQ ID NO: 254252 - protein, 15 aa, Homo sapiens
  Native (MAGC1_HUMAN)
SSTLLSIFQSSPERT

SEQ ID NO: 254253 - protein, 16 aa, Homo sapiens
  Native (MAGC1_HUMAN)
SSTLLSIFQSSPERTQ

SEQ ID NO: 254254 - protein, 17 aa, Homo sapiens
  Native (MAGC1_HUMAN)
SSTLLSIFQSSPERTQS

SEQ ID NO: 254255 - protein, 18 aa, Homo sapiens
  Native (MAGC1_HUMAN)
SSTLLSIFQSSPERTQST

SEQ ID NO: 254256 - protein, 19 aa, Homo sapiens
  Native (MAGC1_HUMAN)
SSTLLSIFQSSPERTQSTF

SEQ ID NO: 254257 - protein, 20 aa, Homo sapiens
  Native (MAGC1_HUMAN)
SSTLLSIFQSSPERTQSTFE

SEQ ID NO: 254258 - protein, 21 aa, Homo sapiens
  Native (MAGC1_HUMAN)
SSTLLSIFQSSPERTQSTFEG

SEQ ID NO: 254259 - protein, 22 aa, Homo sapiens
  Native (MAGC1_HUMAN)
SSTLLSIFQSSPERTQSTFEGF

SEQ ID NO: 254260 - protein, 23 aa, Homo sapiens
  Native (MAGC1_HUMAN)
SSTLLSIFQSSPERTQSTFEGFA

SEQ ID NO: 254261 - protein, 24 aa, Homo sapiens
  Native (MAGC1_HUMAN)
SSTLLSIFQSSPERTQSTFEGFAQ

SEQ ID NO: 254262 - protein, 25 aa, Homo sapiens
  Native (MAGC1_HUMAN)
SSTLLSIFQSSPERTQSTFEGFAQS

SEQ ID NO: 254263 - protein, 14 aa, Homo sapiens
  Native (MAGC1_HUMAN)
SSTLLSIFQSSPES

SEQ ID NO: 254264 - protein, 15 aa, Homo sapiens
  Native (MAGC1_HUMAN)
SSTLLSIFQSSPESA

SEQ ID NO: 254265 - protein, 16 aa, Homo sapiens
  Native (MAGC1_HUMAN)
SSTLLSIFQSSPESAQ

SEQ ID NO: 254266 - protein, 17 aa, Homo sapiens
  Native (MAGC1_HUMAN)
SSTLLSIFQSSPESAQS

SEQ ID NO: 254267 - protein, 18 aa, Homo sapiens
  Native (MAGC1_HUMAN)
SSTLLSIFQSSPESAQST

SEQ ID NO: 254268 - protein, 19 aa, Homo sapiens
  Native (MAGC1_HUMAN)
SSTLLSIFQSSPESAQSTF

SEQ ID NO: 254269 - protein, 20 aa, Homo sapiens
  Native (MAGC1_HUMAN)
SSTLLSIFQSSPESAQSTFE

SEQ ID NO: 254270 - protein, 21 aa, Homo sapiens
  Native (MAGC1_HUMAN)
SSTLLSIFQSSPESAQSTFEG

SEQ ID NO: 254271 - protein, 22 aa, Homo sapiens
  Native (MAGC1_HUMAN)
SSTLLSIFQSSPESAQSTFEGF

SEQ ID NO: 254272 - protein, 23 aa, Homo sapiens
  Native (MAGC1_HUMAN)
SSTLLSIFQSSPESAQSTFEGFP

SEQ ID NO: 254273 - protein, 24 aa, Homo sapiens
  Native (MAGC1_HUMAN)
SSTLLSIFQSSPESAQSTFEGFPQ

SEQ ID NO: 254274 - protein, 25 aa, Homo sapiens
  Native (MAGC1_HUMAN)
SSTLLSIFQSSPESAQSTFEGFPQS

SEQ ID NO: 254275 - protein, 14 aa, Homo sapiens
  Native (MAGC1_HUMAN)
SSTLLSILQSSPES

SEQ ID NO: 254276 - protein, 15 aa, Homo sapiens
  Native (MAGC1_HUMAN)
SSTLLSILQSSPESA

SEQ ID NO: 254277 - protein, 16 aa, Homo sapiens
  Native (MAGC1_HUMAN)
SSTLLSILQSSPESAQ

SEQ ID NO: 254278 - protein, 17 aa, Homo sapiens
  Native (MAGC1_HUMAN)
SSTLLSILQSSPESAQS

SEQ ID NO: 254279 - protein, 18 aa, Homo sapiens
  Native (MAGC1_HUMAN)
SSTLLSILQSSPESAQSA

SEQ ID NO: 254280 - protein, 19 aa, Homo sapiens
  Native (MAGC1_HUMAN)
SSTLLSILQSSPESAQSAF

SEQ ID NO: 254281 - protein, 20 aa, Homo sapiens
  Native (MAGC1_HUMAN)
SSTLLSILQSSPESAQSAFE

SEQ ID NO: 254282 - protein, 21 aa, Homo sapiens
  Native (MAGC1_HUMAN)
SSTLLSILQSSPESAQSAFEG

SEQ ID NO: 254283 - protein, 22 aa, Homo sapiens
  Native (MAGC1_HUMAN)
SSTLLSILQSSPESAQSAFEGF

SEQ ID NO: 254284 - protein, 23 aa, Homo sapiens
  Native (MAGC1_HUMAN)
SSTLLSILQSSPESAQSAFEGFP

SEQ ID NO: 254285 - protein, 24 aa, Homo sapiens
  Native (MAGC1_HUMAN)
SSTLLSILQSSPESAQSAFEGFPQ

SEQ ID NO: 254286 - protein, 25 aa, Homo sapiens
  Native (MAGC1_HUMAN)
SSTLLSILQSSPESAQSAFEGFPQS

SEQ ID NO: 254287 - protein, 13 aa, Homo sapiens
  Native (MAGC1_HUMAN)
SSTLLSLFQSFSE

SEQ ID NO: 254288 - protein, 14 aa, Homo sapiens
  Native (MAGC1_HUMAN)
SSTLLSLFQSFSER

SEQ ID NO: 254289 - protein, 15 aa, Homo sapiens
  Native (MAGC1_HUMAN)
SSTLLSLFQSFSERT

SEQ ID NO: 254290 - protein, 16 aa, Homo sapiens
  Native (MAGC1_HUMAN)
SSTLLSLFQSFSERTQ

SEQ ID NO: 254291 - protein, 17 aa, Homo sapiens
  Native (MAGC1_HUMAN)
SSTLLSLFQSFSERTQS

SEQ ID NO: 254292 - protein, 18 aa, Homo sapiens
  Native (MAGC1_HUMAN)
SSTLLSLFQSFSERTQST

SEQ ID NO: 254293 - protein, 19 aa, Homo sapiens
  Native (MAGC1_HUMAN)
SSTLLSLFQSFSERTQSTF

SEQ ID NO: 254294 - protein, 20 aa, Homo sapiens
  Native (MAGC1_HUMAN)
SSTLLSLFQSFSERTQSTFE

SEQ ID NO: 254295 - protein, 21 aa, Homo sapiens
  Native (MAGC1_HUMAN)
SSTLLSLFQSFSERTQSTFEG

SEQ ID NO: 254296 - protein, 22 aa, Homo sapiens
  Native (MAGC1_HUMAN)
SSTLLSLFQSFSERTQSTFEGF

SEQ ID NO: 254297 - protein, 23 aa, Homo sapiens
  Native (MAGC1_HUMAN)
SSTLLSLFQSFSERTQSTFEGFA

SEQ ID NO: 254298 - protein, 24 aa, Homo sapiens
  Native (MAGC1_HUMAN)
SSTLLSLFQSFSERTQSTFEGFAQ

SEQ ID NO: 254299 - protein, 25 aa, Homo sapiens
  Native (MAGC1_HUMAN)
SSTLLSLFQSFSERTQSTFEGFAQS

SEQ ID NO: 254300 - protein, 13 aa, Homo sapiens
  Native (MAGC1_HUMAN)
SSTLLSLFQSSPE

SEQ ID NO: 254301 - protein, 14 aa, Homo sapiens
  Native (MAGC1_HUMAN)
SSTLLSLFQSSPEC

SEQ ID NO: 254302 - protein, 15 aa, Homo sapiens
  Native (MAGC1_HUMAN)
SSTLLSLFQSSPECT

SEQ ID NO: 254303 - protein, 16 aa, Homo sapiens
  Native (MAGC1_HUMAN)
SSTLLSLFQSSPECTQ

SEQ ID NO: 254304 - protein, 17 aa, Homo sapiens
  Native (MAGC1_HUMAN)
SSTLLSLFQSSPECTQS

SEQ ID NO: 254305 - protein, 18 aa, Homo sapiens
  Native (MAGC1_HUMAN)
SSTLLSLFQSSPECTQST

SEQ ID NO: 254306 - protein, 19 aa, Homo sapiens
  Native (MAGC1_HUMAN)
SSTLLSLFQSSPECTQSTF

SEQ ID NO: 254307 - protein, 20 aa, Homo sapiens
  Native (MAGC1_HUMAN)
SSTLLSLFQSSPECTQSTFE

SEQ ID NO: 254308 - protein, 21 aa, Homo sapiens
  Native (MAGC1_HUMAN)
SSTLLSLFQSSPECTQSTFEG

SEQ ID NO: 254309 - protein, 22 aa, Homo sapiens
  Native (MAGC1_HUMAN)
SSTLLSLFQSSPECTQSTFEGF

SEQ ID NO: 254310 - protein, 23 aa, Homo sapiens
  Native (MAGC1_HUMAN)
SSTLLSLFQSSPECTQSTFEGFP

SEQ ID NO: 254311 - protein, 24 aa, Homo sapiens
  Native (MAGC1_HUMAN)
SSTLLSLFQSSPECTQSTFEGFPQ

SEQ ID NO: 254312 - protein, 25 aa, Homo sapiens
  Native (MAGC1_HUMAN)
SSTLLSLFQSSPECTQSTFEGFPQS

SEQ ID NO: 254313 - protein, 14 aa, Homo sapiens
  Native (MAGC1_HUMAN)
SSTLLSLFQSSPER

SEQ ID NO: 254314 - protein, 16 aa, Homo sapiens
  Native (MAGC1_HUMAN)
SSTLLSLFQSSPERTH

SEQ ID NO: 254315 - protein, 17 aa, Homo sapiens
  Native (MAGC1_HUMAN)
SSTLLSLFQSSPERTHS

SEQ ID NO: 254316 - protein, 18 aa, Homo sapiens
  Native (MAGC1_HUMAN)
SSTLLSLFQSSPERTHST

SEQ ID NO: 254317 - protein, 19 aa, Homo sapiens
  Native (MAGC1_HUMAN)
SSTLLSLFQSSPERTHSTF

SEQ ID NO: 254318 - protein, 20 aa, Homo sapiens
  Native (MAGC1_HUMAN)
SSTLLSLFQSSPERTHSTFE

SEQ ID NO: 254319 - protein, 21 aa, Homo sapiens
  Native (MAGC1_HUMAN)
SSTLLSLFQSSPERTHSTFEG

SEQ ID NO: 254320 - protein, 22 aa, Homo sapiens
  Native (MAGC1_HUMAN)
SSTLLSLFQSSPERTHSTFEGF

SEQ ID NO: 254321 - protein, 23 aa, Homo sapiens
  Native (MAGC1_HUMAN)
SSTLLSLFQSSPERTHSTFEGFP

SEQ ID NO: 254322 - protein, 24 aa, Homo sapiens
  Native (MAGC1_HUMAN)
SSTLLSLFQSSPERTHSTFEGFPQ

SEQ ID NO: 254323 - protein, 25 aa, Homo sapiens
  Native (MAGC1_HUMAN)
SSTLLSLFQSSPERTHSTFEGFPQS

SEQ ID NO: 254324 - protein, 13 aa, Homo sapiens
  Native (MAGC1_HUMAN)
SSTLVSIFQSSPE

SEQ ID NO: 254325 - protein, 14 aa, Homo sapiens
  Native (MAGC1_HUMAN)
SSTLVSIFQSSPES

SEQ ID NO: 254326 - protein, 15 aa, Homo sapiens
  Native (MAGC1_HUMAN)
SSTLVSIFQSSPEST

SEQ ID NO: 254327 - protein, 16 aa, Homo sapiens
  Native (MAGC1_HUMAN)
SSTLVSIFQSSPESTQ

SEQ ID NO: 254328 - protein, 17 aa, Homo sapiens
  Native (MAGC1_HUMAN)
SSTLVSIFQSSPESTQS

SEQ ID NO: 254329 - protein, 18 aa, Homo sapiens
  Native (MAGC1_HUMAN)
SSTLVSIFQSSPESTQSP

SEQ ID NO: 254330 - protein, 19 aa, Homo sapiens
  Native (MAGC1_HUMAN)
SSTLVSIFQSSPESTQSPF

SEQ ID NO: 254331 - protein, 20 aa, Homo sapiens
  Native (MAGC1_HUMAN)
SSTLVSIFQSSPESTQSPFE

SEQ ID NO: 254332 - protein, 21 aa, Homo sapiens
  Native (MAGC1_HUMAN)
SSTLVSIFQSSPESTQSPFEG

SEQ ID NO: 254333 - protein, 22 aa, Homo sapiens
  Native (MAGC1_HUMAN)
SSTLVSIFQSSPESTQSPFEGF

SEQ ID NO: 254334 - protein, 23 aa, Homo sapiens
  Native (MAGC1_HUMAN)
SSTLVSIFQSSPESTQSPFEGFP

SEQ ID NO: 254335 - protein, 24 aa, Homo sapiens
  Native (MAGC1_HUMAN)
SSTLVSIFQSSPESTQSPFEGFPQ

SEQ ID NO: 254336 - protein, 25 aa, Homo sapiens
  Native (MAGC1_HUMAN)
SSTLVSIFQSSPESTQSPFEGFPQS

SEQ ID NO: 254337 - protein, 13 aa, Homo sapiens
  Native (MAGC1_HUMAN)
SSTLVSLFQSSPE

SEQ ID NO: 254338 - protein, 14 aa, Homo sapiens
  Native (MAGC1_HUMAN)
SSTLVSLFQSSPER

SEQ ID NO: 254339 - protein, 15 aa, Homo sapiens
  Native (MAGC1_HUMAN)
SSTLVSLFQSSPERT

SEQ ID NO: 254340 - protein, 16 aa, Homo sapiens
  Native (MAGC1_HUMAN)
SSTLVSLFQSSPERTQ

SEQ ID NO: 254341 - protein, 17 aa, Homo sapiens
  Native (MAGC1_HUMAN)
SSTLVSLFQSSPERTQS

SEQ ID NO: 254342 - protein, 18 aa, Homo sapiens
  Native (MAGC1_HUMAN)
SSTLVSLFQSSPERTQST

SEQ ID NO: 254343 - protein, 19 aa, Homo sapiens
  Native (MAGC1_HUMAN)
SSTLVSLFQSSPERTQSTF

SEQ ID NO: 254344 - protein, 20 aa, Homo sapiens
  Native (MAGC1_HUMAN)
SSTLVSLFQSSPERTQSTFE

SEQ ID NO: 254345 - protein, 21 aa, Homo sapiens
  Native (MAGC1_HUMAN)
SSTLVSLFQSSPERTQSTFEG

SEQ ID NO: 254346 - protein, 22 aa, Homo sapiens
  Native (MAGC1_HUMAN)
SSTLVSLFQSSPERTQSTFEGF

SEQ ID NO: 254347 - protein, 23 aa, Homo sapiens
  Native (MAGC1_HUMAN)
SSTLVSLFQSSPERTQSTFEGFP

SEQ ID NO: 254348 - protein, 24 aa, Homo sapiens
  Native (MAGC1_HUMAN)
SSTLVSLFQSSPERTQSTFEGFPQ

SEQ ID NO: 254349 - protein, 25 aa, Homo sapiens
  Native (MAGC1_HUMAN)
SSTLVSLFQSSPERTQSTFEGFPQS

SEQ ID NO: 254350 - protein, 14 aa, Homo sapiens
  Native (MAGC1_HUMAN)
SSTSLSLPQSFPES

SEQ ID NO: 254351 - protein, 15 aa, Homo sapiens
  Native (MAGC1_HUMAN)
SSTSLSLPQSFPESP

SEQ ID NO: 254352 - protein, 16 aa, Homo sapiens
  Native (MAGC1_HUMAN)
SSTSLSLPQSFPESPQ

SEQ ID NO: 254353 - protein, 20 aa, Homo sapiens
  Native (MAGC1_HUMAN)
SSTSLSPFSEESSSPVDEYT

SEQ ID NO: 254354 - protein, 14 aa, Homo sapiens
  Native (MAGC1_HUMAN)
SSTSSSLSKSSPES

SEQ ID NO: 254355 - protein, 15 aa, Homo sapiens
  Native (MAGC1_HUMAN)
SSTSSSLSKSSPESP

SEQ ID NO: 254356 - protein, 16 aa, Homo sapiens
  Native (MAGC1_HUMAN)
SSTSSSLSKSSPESPL

SEQ ID NO: 254357 - protein, 17 aa, Homo sapiens
  Native (MAGC1_HUMAN)
SSTSSSLSKSSPESPLQ

SEQ ID NO: 254358 - protein, 20 aa, Homo sapiens
  Native (MAGC1_HUMAN)
SSTSSSLSKSSPESPLQSPV

SEQ ID NO: 254359 - protein, 13 aa, Homo sapiens
  Native (MAGC1_HUMAN)
SSTSSSLSQSSPV

SEQ ID NO: 254360 - protein, 14 aa, Homo sapiens
  Native (MAGC1_HUMAN)
SSTSSSLSQSSPVS

SEQ ID NO: 254361 - protein, 15 aa, Homo sapiens
  Native (MAGC1_HUMAN)
SSTSSSLSQSSPVSS

SEQ ID NO: 254362 - protein, 16 aa, Homo sapiens
  Native (MAGC1_HUMAN)
SSTSSSLSQSSPVSSF

SEQ ID NO: 254363 - protein, 17 aa, Homo sapiens
  Native (MAGC1_HUMAN)
SSTSSSLSQSSPVSSFP

SEQ ID NO: 254364 - protein, 18 aa, Homo sapiens
  Native (MAGC1_HUMAN)
SSTSSSLSQSSPVSSFPS

SEQ ID NO: 254365 - protein, 19 aa, Homo sapiens
  Native (MAGC1_HUMAN)
SSTSSSLSQSSPVSSFPSS

SEQ ID NO: 254366 - protein, 20 aa, Homo sapiens
  Native (MAGC1_HUMAN)
SSTSSSLSQSSPVSSFPSST

SEQ ID NO: 254367 - protein, 21 aa, Homo sapiens
  Native (MAGC1_HUMAN)
SSTSSSLSQSSPVSSFPSSTS

SEQ ID NO: 254368 - protein, 22 aa, Homo sapiens
  Native (MAGC1_HUMAN)
SSTSSSLSQSSPVSSFPSSTSS

SEQ ID NO: 254369 - protein, 23 aa, Homo sapiens
  Native (MAGC1_HUMAN)
SSTSSSLSQSSPVSSFPSSTSSS

SEQ ID NO: 254370 - protein, 24 aa, Homo sapiens
  Native (MAGC1_HUMAN)
SSTSSSLSQSSPVSSFPSSTSSSL

SEQ ID NO: 254371 - protein, 25 aa, Homo sapiens
  Native (MAGC1_HUMAN)
SSTSSSLSQSSPVSSFPSSTSSSLS

SEQ ID NO: 254372 - protein, 13 aa, Homo sapiens
  Native (MAGC1_HUMAN)
STATESASSSVMS

SEQ ID NO: 254373 - protein, 14 aa, Homo sapiens
  Native (MAGC1_HUMAN)
STATESASSSVMSP

SEQ ID NO: 254374 - protein, 15 aa, Homo sapiens
  Native (MAGC1_HUMAN)
STATESASSSVMSPS

SEQ ID NO: 254375 - protein, 16 aa, Homo sapiens
  Native (MAGC1_HUMAN)
STATESASSSVMSPSF

SEQ ID NO: 254376 - protein, 17 aa, Homo sapiens
  Native (MAGC1_HUMAN)
STATESASSSVMSPSFS

SEQ ID NO: 254377 - protein, 18 aa, Homo sapiens
  Native (MAGC1_HUMAN)
STATESASSSVMSPSFSS

SEQ ID NO: 254378 - protein, 19 aa, Homo sapiens
  Native (MAGC1_HUMAN)
STATESASSSVMSPSFSSE

SEQ ID NO: 254379 - protein, 14 aa, Homo sapiens
  Native (MAGC1_HUMAN)
STFEGFAQSPLQIP

SEQ ID NO: 254380 - protein, 15 aa, Homo sapiens
  Native (MAGC1_HUMAN)
STFEGFAQSPLQIPV

SEQ ID NO: 254381 - protein, 16 aa, Homo sapiens
  Native (MAGC1_HUMAN)
STFEGFAQSPLQIPVS

SEQ ID NO: 254382 - protein, 17 aa, Homo sapiens
  Native (MAGC1_HUMAN)
STFEGFAQSPLQIPVSP

SEQ ID NO: 254383 - protein, 18 aa, Homo sapiens
  Native (MAGC1_HUMAN)
STFEGFAQSPLQIPVSPS

SEQ ID NO: 254384 - protein, 19 aa, Homo sapiens
  Native (MAGC1_HUMAN)
STFEGFAQSPLQIPVSPSS

SEQ ID NO: 254385 - protein, 20 aa, Homo sapiens
  Native (MAGC1_HUMAN)
STFEGFAQSPLQIPVSPSSS

SEQ ID NO: 254386 - protein, 21 aa, Homo sapiens
  Native (MAGC1_HUMAN)
STFEGFAQSPLQIPVSPSSSS

SEQ ID NO: 254387 - protein, 22 aa, Homo sapiens
  Native (MAGC1_HUMAN)
STFEGFAQSPLQIPVSPSSSST

SEQ ID NO: 254388 - protein, 23 aa, Homo sapiens
  Native (MAGC1_HUMAN)
STFEGFAQSPLQIPVSPSSSSTL

SEQ ID NO: 254389 - protein, 24 aa, Homo sapiens
  Native (MAGC1_HUMAN)
STFEGFAQSPLQIPVSPSSSSTLL

SEQ ID NO: 254390 - protein, 25 aa, Homo sapiens
  Native (MAGC1_HUMAN)
STFEGFAQSPLQIPVSPSSSSTLLS

SEQ ID NO: 254391 - protein, 14 aa, Homo sapiens
  Native (MAGC1_HUMAN)
STFEGFAQSSLQIP

SEQ ID NO: 254392 - protein, 15 aa, Homo sapiens
  Native (MAGC1_HUMAN)
STFEGFAQSSLQIPV

SEQ ID NO: 254393 - protein, 16 aa, Homo sapiens
  Native (MAGC1_HUMAN)
STFEGFAQSSLQIPVS

SEQ ID NO: 254394 - protein, 17 aa, Homo sapiens
  Native (MAGC1_HUMAN)
STFEGFAQSSLQIPVSP

SEQ ID NO: 254395 - protein, 18 aa, Homo sapiens
  Native (MAGC1_HUMAN)
STFEGFAQSSLQIPVSPS

SEQ ID NO: 254396 - protein, 19 aa, Homo sapiens
  Native (MAGC1_HUMAN)
STFEGFAQSSLQIPVSPSF

SEQ ID NO: 254397 - protein, 20 aa, Homo sapiens
  Native (MAGC1_HUMAN)
STFEGFAQSSLQIPVSPSFS

SEQ ID NO: 254398 - protein, 21 aa, Homo sapiens
  Native (MAGC1_HUMAN)
STFEGFAQSSLQIPVSPSFSS

SEQ ID NO: 254399 - protein, 22 aa, Homo sapiens
  Native (MAGC1_HUMAN)
STFEGFAQSSLQIPVSPSFSST

SEQ ID NO: 254400 - protein, 23 aa, Homo sapiens
  Native (MAGC1_HUMAN)
STFEGFAQSSLQIPVSPSFSSTL

SEQ ID NO: 254401 - protein, 24 aa, Homo sapiens
  Native (MAGC1_HUMAN)
STFEGFAQSSLQIPVSPSFSSTLV

SEQ ID NO: 254402 - protein, 25 aa, Homo sapiens
  Native (MAGC1_HUMAN)
STFEGFAQSSLQIPVSPSFSSTLVS

SEQ ID NO: 254403 - protein, 13 aa, Homo sapiens
  Native (MAGC1_HUMAN)
STFEGFPQSLLQI

SEQ ID NO: 254404 - protein, 14 aa, Homo sapiens
  Native (MAGC1_HUMAN)
STFEGFPQSLLQIP

SEQ ID NO: 254405 - protein, 15 aa, Homo sapiens
  Native (MAGC1_HUMAN)
STFEGFPQSLLQIPM

SEQ ID NO: 254406 - protein, 16 aa, Homo sapiens
  Native (MAGC1_HUMAN)
STFEGFPQSLLQIPMT

SEQ ID NO: 254407 - protein, 17 aa, Homo sapiens
  Native (MAGC1_HUMAN)
STFEGFPQSLLQIPMTS

SEQ ID NO: 254408 - protein, 18 aa, Homo sapiens
  Native (MAGC1_HUMAN)
STFEGFPQSLLQIPMTSS

SEQ ID NO: 254409 - protein, 19 aa, Homo sapiens
  Native (MAGC1_HUMAN)
STFEGFPQSLLQIPMTSSF

SEQ ID NO: 254410 - protein, 20 aa, Homo sapiens
  Native (MAGC1_HUMAN)
STFEGFPQSLLQIPMTSSFS

SEQ ID NO: 254411 - protein, 21 aa, Homo sapiens
  Native (MAGC1_HUMAN)
STFEGFPQSLLQIPMTSSFSS

SEQ ID NO: 254412 - protein, 22 aa, Homo sapiens
  Native (MAGC1_HUMAN)
STFEGFPQSLLQIPMTSSFSST

SEQ ID NO: 254413 - protein, 23 aa, Homo sapiens
  Native (MAGC1_HUMAN)
STFEGFPQSLLQIPMTSSFSSTL

SEQ ID NO: 254414 - protein, 24 aa, Homo sapiens
  Native (MAGC1_HUMAN)
STFEGFPQSLLQIPMTSSFSSTLL

SEQ ID NO: 254415 - protein, 25 aa, Homo sapiens
  Native (MAGC1_HUMAN)
STFEGFPQSLLQIPMTSSFSSTLLS

SEQ ID NO: 254416 - protein, 14 aa, Homo sapiens
  Native (MAGC1_HUMAN)
STFEGFPQSPLQIP

SEQ ID NO: 254417 - protein, 15 aa, Homo sapiens
  Native (MAGC1_HUMAN)
STFEGFPQSPLQIPG

SEQ ID NO: 254418 - protein, 16 aa, Homo sapiens
  Native (MAGC1_HUMAN)
STFEGFPQSPLQIPGS

SEQ ID NO: 254419 - protein, 20 aa, Homo sapiens
  Native (MAGC1_HUMAN)
STFEGFPQSPLQIPGSPSFS

SEQ ID NO: 254420 - protein, 23 aa, Homo sapiens
  Native (MAGC1_HUMAN)
STFEGFPQSPLQIPGSPSFSSTL

SEQ ID NO: 254421 - protein, 24 aa, Homo sapiens
  Native (MAGC1_HUMAN)
STFEGFPQSPLQIPGSPSFSSTLL

SEQ ID NO: 254422 - protein, 25 aa, Homo sapiens
  Native (MAGC1_HUMAN)
STFEGFPQSPLQIPGSPSFSSTLLS

SEQ ID NO: 254423 - protein, 15 aa, Homo sapiens
  Native (MAGC1_HUMAN)
STFEGFPQSPLQIPM

SEQ ID NO: 254424 - protein, 16 aa, Homo sapiens
  Native (MAGC1_HUMAN)
STFEGFPQSPLQIPMT

SEQ ID NO: 254425 - protein, 17 aa, Homo sapiens
  Native (MAGC1_HUMAN)
STFEGFPQSPLQIPMTS

SEQ ID NO: 254426 - protein, 19 aa, Homo sapiens
  Native (MAGC1_HUMAN)
STFEGFPQSPLQIPMTSSF

SEQ ID NO: 254427 - protein, 20 aa, Homo sapiens
  Native (MAGC1_HUMAN)
STFEGFPQSPLQIPMTSSFS

SEQ ID NO: 254428 - protein, 21 aa, Homo sapiens
  Native (MAGC1_HUMAN)
STFEGFPQSPLQIPMTSSFSS

SEQ ID NO: 254429 - protein, 22 aa, Homo sapiens
  Native (MAGC1_HUMAN)
STFEGFPQSPLQIPMTSSFSST

SEQ ID NO: 254430 - protein, 23 aa, Homo sapiens
  Native (MAGC1_HUMAN)
STFEGFPQSPLQIPMTSSFSSTL

SEQ ID NO: 254431 - protein, 24 aa, Homo sapiens
  Native (MAGC1_HUMAN)
STFEGFPQSPLQIPMTSSFSSTLL

SEQ ID NO: 254432 - protein, 25 aa, Homo sapiens
  Native (MAGC1_HUMAN)
STFEGFPQSPLQIPMTSSFSSTLLS

SEQ ID NO: 254433 - protein, 15 aa, Homo sapiens
  Native (MAGC1_HUMAN)
STFEGFPQSPLQIPQ

SEQ ID NO: 254434 - protein, 16 aa, Homo sapiens
  Native (MAGC1_HUMAN)
STFEGFPQSPLQIPQS

SEQ ID NO: 254435 - protein, 17 aa, Homo sapiens
  Native (MAGC1_HUMAN)
STFEGFPQSPLQIPQSP

SEQ ID NO: 254436 - protein, 19 aa, Homo sapiens
  Native (MAGC1_HUMAN)
STFEGFPQSPLQIPQSPPE

SEQ ID NO: 254437 - protein, 20 aa, Homo sapiens
  Native (MAGC1_HUMAN)
STFEGFPQSPLQIPQSPPEG

SEQ ID NO: 254438 - protein, 15 aa, Homo sapiens
  Native (MAGC1_HUMAN)
STFEGFPQSPLQIPV

SEQ ID NO: 254439 - protein, 16 aa, Homo sapiens
  Native (MAGC1_HUMAN)
STFEGFPQSPLQIPVS

SEQ ID NO: 254440 - protein, 17 aa, Homo sapiens
  Native (MAGC1_HUMAN)
STFEGFPQSPLQIPVSS

SEQ ID NO: 254441 - protein, 19 aa, Homo sapiens
  Native (MAGC1_HUMAN)
STFEGFPQSPLQIPVSSSS

SEQ ID NO: 254442 - protein, 20 aa, Homo sapiens
  Native (MAGC1_HUMAN)
STFEGFPQSPLQIPVSSSSS

SEQ ID NO: 254443 - protein, 21 aa, Homo sapiens
  Native (MAGC1_HUMAN)
STFEGFPQSPLQIPVSSSSSS

SEQ ID NO: 254444 - protein, 22 aa, Homo sapiens
  Native (MAGC1_HUMAN)
STFEGFPQSPLQIPVSSSSSSS

SEQ ID NO: 254445 - protein, 23 aa, Homo sapiens
  Native (MAGC1_HUMAN)
STFEGFPQSPLQIPVSSSSSSST

SEQ ID NO: 254446 - protein, 24 aa, Homo sapiens
  Native (MAGC1_HUMAN)
STFEGFPQSPLQIPVSSSSSSSTL

SEQ ID NO: 254447 - protein, 25 aa, Homo sapiens
  Native (MAGC1_HUMAN)
STFEGFPQSPLQIPVSSSSSSSTLL

SEQ ID NO: 254448 - protein, 22 aa, Homo sapiens
  Native (MAGC1_HUMAN)
STFEGFPQSPLQIPVSSSSSST

SEQ ID NO: 254449 - protein, 23 aa, Homo sapiens
  Native (MAGC1_HUMAN)
STFEGFPQSPLQIPVSSSSSSTL

SEQ ID NO: 254450 - protein, 24 aa, Homo sapiens
  Native (MAGC1_HUMAN)
STFEGFPQSPLQIPVSSSSSSTLL

SEQ ID NO: 254451 - protein, 25 aa, Homo sapiens
  Native (MAGC1_HUMAN)
STFEGFPQSPLQIPVSSSSSSTLLS

SEQ ID NO: 254452 - protein, 13 aa, Homo sapiens
  Native (MAGC1_HUMAN)
STLLSIFQSSPER

SEQ ID NO: 254453 - protein, 14 aa, Homo sapiens
  Native (MAGC1_HUMAN)
STLLSIFQSSPERT

SEQ ID NO: 254454 - protein, 15 aa, Homo sapiens
  Native (MAGC1_HUMAN)
STLLSIFQSSPERTQ

SEQ ID NO: 254455 - protein, 16 aa, Homo sapiens
  Native (MAGC1_HUMAN)
STLLSIFQSSPERTQS

SEQ ID NO: 254456 - protein, 17 aa, Homo sapiens
  Native (MAGC1_HUMAN)
STLLSIFQSSPERTQST

SEQ ID NO: 254457 - protein, 18 aa, Homo sapiens
  Native (MAGC1_HUMAN)
STLLSIFQSSPERTQSTF

SEQ ID NO: 254458 - protein, 19 aa, Homo sapiens
  Native (MAGC1_HUMAN)
STLLSIFQSSPERTQSTFE

SEQ ID NO: 254459 - protein, 20 aa, Homo sapiens
  Native (MAGC1_HUMAN)
STLLSIFQSSPERTQSTFEG

SEQ ID NO: 254460 - protein, 21 aa, Homo sapiens
  Native (MAGC1_HUMAN)
STLLSIFQSSPERTQSTFEGF

SEQ ID NO: 254461 - protein, 22 aa, Homo sapiens
  Native (MAGC1_HUMAN)
STLLSIFQSSPERTQSTFEGFA

SEQ ID NO: 254462 - protein, 23 aa, Homo sapiens
  Native (MAGC1_HUMAN)
STLLSIFQSSPERTQSTFEGFAQ

SEQ ID NO: 254463 - protein, 24 aa, Homo sapiens
  Native (MAGC1_HUMAN)
STLLSIFQSSPERTQSTFEGFAQS

SEQ ID NO: 254464 - protein, 25 aa, Homo sapiens
  Native (MAGC1_HUMAN)
STLLSIFQSSPERTQSTFEGFAQSP

SEQ ID NO: 254465 - protein, 13 aa, Homo sapiens
  Native (MAGC1_HUMAN)
STLLSIFQSSPES

SEQ ID NO: 254466 - protein, 14 aa, Homo sapiens
  Native (MAGC1_HUMAN)
STLLSIFQSSPESA

SEQ ID NO: 254467 - protein, 15 aa, Homo sapiens
  Native (MAGC1_HUMAN)
STLLSIFQSSPESAQ

SEQ ID NO: 254468 - protein, 16 aa, Homo sapiens
  Native (MAGC1_HUMAN)
STLLSIFQSSPESAQS

SEQ ID NO: 254469 - protein, 17 aa, Homo sapiens
  Native (MAGC1_HUMAN)
STLLSIFQSSPESAQST

SEQ ID NO: 254470 - protein, 18 aa, Homo sapiens
  Native (MAGC1_HUMAN)
STLLSIFQSSPESAQSTF

SEQ ID NO: 254471 - protein, 19 aa, Homo sapiens
  Native (MAGC1_HUMAN)
STLLSIFQSSPESAQSTFE

SEQ ID NO: 254472 - protein, 20 aa, Homo sapiens
  Native (MAGC1_HUMAN)
STLLSIFQSSPESAQSTFEG

SEQ ID NO: 254473 - protein, 21 aa, Homo sapiens
  Native (MAGC1_HUMAN)
STLLSIFQSSPESAQSTFEGF

SEQ ID NO: 254474 - protein, 22 aa, Homo sapiens
  Native (MAGC1_HUMAN)
STLLSIFQSSPESAQSTFEGFP

SEQ ID NO: 254475 - protein, 23 aa, Homo sapiens
  Native (MAGC1_HUMAN)
STLLSIFQSSPESAQSTFEGFPQ

SEQ ID NO: 254476 - protein, 24 aa, Homo sapiens
  Native (MAGC1_HUMAN)
STLLSIFQSSPESAQSTFEGFPQS

SEQ ID NO: 254477 - protein, 25 aa, Homo sapiens
  Native (MAGC1_HUMAN)
STLLSIFQSSPESAQSTFEGFPQSP

SEQ ID NO: 254478 - protein, 14 aa, Homo sapiens
  Native (MAGC1_HUMAN)
STLLSILQSSPESA

SEQ ID NO: 254479 - protein, 15 aa, Homo sapiens
  Native (MAGC1_HUMAN)
STLLSILQSSPESAQ

SEQ ID NO: 254480 - protein, 16 aa, Homo sapiens
  Native (MAGC1_HUMAN)
STLLSILQSSPESAQS

SEQ ID NO: 254481 - protein, 17 aa, Homo sapiens
  Native (MAGC1_HUMAN)
STLLSILQSSPESAQSA

SEQ ID NO: 254482 - protein, 18 aa, Homo sapiens
  Native (MAGC1_HUMAN)
STLLSILQSSPESAQSAF

SEQ ID NO: 254483 - protein, 19 aa, Homo sapiens
  Native (MAGC1_HUMAN)
STLLSILQSSPESAQSAFE

SEQ ID NO: 254484 - protein, 20 aa, Homo sapiens
  Native (MAGC1_HUMAN)
STLLSILQSSPESAQSAFEG

SEQ ID NO: 254485 - protein, 21 aa, Homo sapiens
  Native (MAGC1_HUMAN)
STLLSILQSSPESAQSAFEGF

SEQ ID NO: 254486 - protein, 22 aa, Homo sapiens
  Native (MAGC1_HUMAN)
STLLSILQSSPESAQSAFEGFP

SEQ ID NO: 254487 - protein, 23 aa, Homo sapiens
  Native (MAGC1_HUMAN)
STLLSILQSSPESAQSAFEGFPQ

SEQ ID NO: 254488 - protein, 24 aa, Homo sapiens
  Native (MAGC1_HUMAN)
STLLSILQSSPESAQSAFEGFPQS

SEQ ID NO: 254489 - protein, 25 aa, Homo sapiens
  Native (MAGC1_HUMAN)
STLLSILQSSPESAQSAFEGFPQSP

SEQ ID NO: 254490 - protein, 13 aa, Homo sapiens
  Native (MAGC1_HUMAN)
STLLSLFQSFSER

SEQ ID NO: 254491 - protein, 14 aa, Homo sapiens
  Native (MAGC1_HUMAN)
STLLSLFQSFSERT

SEQ ID NO: 254492 - protein, 16 aa, Homo sapiens
  Native (MAGC1_HUMAN)
STLLSLFQSFSERTQS

SEQ ID NO: 254493 - protein, 17 aa, Homo sapiens
  Native (MAGC1_HUMAN)
STLLSLFQSFSERTQST

SEQ ID NO: 254494 - protein, 18 aa, Homo sapiens
  Native (MAGC1_HUMAN)
STLLSLFQSFSERTQSTF

SEQ ID NO: 254495 - protein, 19 aa, Homo sapiens
  Native (MAGC1_HUMAN)
STLLSLFQSFSERTQSTFE

SEQ ID NO: 254496 - protein, 20 aa, Homo sapiens
  Native (MAGC1_HUMAN)
STLLSLFQSFSERTQSTFEG

SEQ ID NO: 254497 - protein, 21 aa, Homo sapiens
  Native (MAGC1_HUMAN)
STLLSLFQSFSERTQSTFEGF

SEQ ID NO: 254498 - protein, 22 aa, Homo sapiens
  Native (MAGC1_HUMAN)
STLLSLFQSFSERTQSTFEGFA

SEQ ID NO: 254499 - protein, 23 aa, Homo sapiens
  Native (MAGC1_HUMAN)
STLLSLFQSFSERTQSTFEGFAQ

SEQ ID NO: 254500 - protein, 24 aa, Homo sapiens
  Native (MAGC1_HUMAN)
STLLSLFQSFSERTQSTFEGFAQS

SEQ ID NO: 254501 - protein, 25 aa, Homo sapiens
  Native (MAGC1_HUMAN)
STLLSLFQSFSERTQSTFEGFAQSS

SEQ ID NO: 254502 - protein, 13 aa, Homo sapiens
  Native (MAGC1_HUMAN)
STLLSLFQSSPEC

SEQ ID NO: 254503 - protein, 14 aa, Homo sapiens
  Native (MAGC1_HUMAN)
STLLSLFQSSPECT

SEQ ID NO: 254504 - protein, 15 aa, Homo sapiens
  Native (MAGC1_HUMAN)
STLLSLFQSSPECTQ

SEQ ID NO: 254505 - protein, 16 aa, Homo sapiens
  Native (MAGC1_HUMAN)
STLLSLFQSSPECTQS

SEQ ID NO: 254506 - protein, 17 aa, Homo sapiens
  Native (MAGC1_HUMAN)
STLLSLFQSSPECTQST

SEQ ID NO: 254507 - protein, 18 aa, Homo sapiens
  Native (MAGC1_HUMAN)
STLLSLFQSSPECTQSTF

SEQ ID NO: 254508 - protein, 19 aa, Homo sapiens
  Native (MAGC1_HUMAN)
STLLSLFQSSPECTQSTFE

SEQ ID NO: 254509 - protein, 20 aa, Homo sapiens
  Native (MAGC1_HUMAN)
STLLSLFQSSPECTQSTFEG

SEQ ID NO: 254510 - protein, 21 aa, Homo sapiens
  Native (MAGC1_HUMAN)
STLLSLFQSSPECTQSTFEGF

SEQ ID NO: 254511 - protein, 22 aa, Homo sapiens
  Native (MAGC1_HUMAN)
STLLSLFQSSPECTQSTFEGFP

SEQ ID NO: 254512 - protein, 23 aa, Homo sapiens
  Native (MAGC1_HUMAN)
STLLSLFQSSPECTQSTFEGFPQ

SEQ ID NO: 254513 - protein, 24 aa, Homo sapiens
  Native (MAGC1_HUMAN)
STLLSLFQSSPECTQSTFEGFPQS

SEQ ID NO: 254514 - protein, 25 aa, Homo sapiens
  Native (MAGC1_HUMAN)
STLLSLFQSSPECTQSTFEGFPQSP

SEQ ID NO: 254515 - protein, 13 aa, Homo sapiens
  Native (MAGC1_HUMAN)
STLLSLFQSSPER

SEQ ID NO: 254516 - protein, 14 aa, Homo sapiens
  Native (MAGC1_HUMAN)
STLLSLFQSSPERT

SEQ ID NO: 254517 - protein, 15 aa, Homo sapiens
  Native (MAGC1_HUMAN)
STLLSLFQSSPERTH

SEQ ID NO: 254518 - protein, 16 aa, Homo sapiens
  Native (MAGC1_HUMAN)
STLLSLFQSSPERTHS

SEQ ID NO: 254519 - protein, 17 aa, Homo sapiens
  Native (MAGC1_HUMAN)
STLLSLFQSSPERTHST

SEQ ID NO: 254520 - protein, 18 aa, Homo sapiens
  Native (MAGC1_HUMAN)
STLLSLFQSSPERTHSTF

SEQ ID NO: 254521 - protein, 19 aa, Homo sapiens
  Native (MAGC1_HUMAN)
STLLSLFQSSPERTHSTFE

SEQ ID NO: 254522 - protein, 20 aa, Homo sapiens
  Native (MAGC1_HUMAN)
STLLSLFQSSPERTHSTFEG

SEQ ID NO: 254523 - protein, 21 aa, Homo sapiens
  Native (MAGC1_HUMAN)
STLLSLFQSSPERTHSTFEGF

SEQ ID NO: 254524 - protein, 22 aa, Homo sapiens
  Native (MAGC1_HUMAN)
STLLSLFQSSPERTHSTFEGFP

SEQ ID NO: 254525 - protein, 23 aa, Homo sapiens
  Native (MAGC1_HUMAN)
STLLSLFQSSPERTHSTFEGFPQ

SEQ ID NO: 254526 - protein, 24 aa, Homo sapiens
  Native (MAGC1_HUMAN)
STLLSLFQSSPERTHSTFEGFPQS

SEQ ID NO: 254527 - protein, 25 aa, Homo sapiens
  Native (MAGC1_HUMAN)
STLLSLFQSSPERTHSTFEGFPQSL

SEQ ID NO: 254528 - protein, 25 aa, Homo sapiens
  Native (MAGC1_HUMAN)
STLLSLFQSSPERTHSTFEGFPQSP

SEQ ID NO: 254529 - protein, 14 aa, Homo sapiens
  Native (MAGC1_HUMAN)
STLVSIFQSSPEST

SEQ ID NO: 254530 - protein, 15 aa, Homo sapiens
  Native (MAGC1_HUMAN)
STLVSIFQSSPESTQ

SEQ ID NO: 254531 - protein, 16 aa, Homo sapiens
  Native (MAGC1_HUMAN)
STLVSIFQSSPESTQS

SEQ ID NO: 254532 - protein, 17 aa, Homo sapiens
  Native (MAGC1_HUMAN)
STLVSIFQSSPESTQSP

SEQ ID NO: 254533 - protein, 19 aa, Homo sapiens
  Native (MAGC1_HUMAN)
STLVSIFQSSPESTQSPFE

SEQ ID NO: 254534 - protein, 20 aa, Homo sapiens
  Native (MAGC1_HUMAN)
STLVSIFQSSPESTQSPFEG

SEQ ID NO: 254535 - protein, 21 aa, Homo sapiens
  Native (MAGC1_HUMAN)
STLVSIFQSSPESTQSPFEGF

SEQ ID NO: 254536 - protein, 22 aa, Homo sapiens
  Native (MAGC1_HUMAN)
STLVSIFQSSPESTQSPFEGFP

SEQ ID NO: 254537 - protein, 23 aa, Homo sapiens
  Native (MAGC1_HUMAN)
STLVSIFQSSPESTQSPFEGFPQ

SEQ ID NO: 254538 - protein, 24 aa, Homo sapiens
  Native (MAGC1_HUMAN)
STLVSIFQSSPESTQSPFEGFPQS

SEQ ID NO: 254539 - protein, 25 aa, Homo sapiens
  Native (MAGC1_HUMAN)
STLVSIFQSSPESTQSPFEGFPQSP

SEQ ID NO: 254540 - protein, 13 aa, Homo sapiens
  Native (MAGC1_HUMAN)
STLVSLFQSSPER

SEQ ID NO: 254541 - protein, 14 aa, Homo sapiens
  Native (MAGC1_HUMAN)
STLVSLFQSSPERT

SEQ ID NO: 254542 - protein, 15 aa, Homo sapiens
  Native (MAGC1_HUMAN)
STLVSLFQSSPERTQ

SEQ ID NO: 254543 - protein, 16 aa, Homo sapiens
  Native (MAGC1_HUMAN)
STLVSLFQSSPERTQS

SEQ ID NO: 254544 - protein, 17 aa, Homo sapiens
  Native (MAGC1_HUMAN)
STLVSLFQSSPERTQST

SEQ ID NO: 254545 - protein, 18 aa, Homo sapiens
  Native (MAGC1_HUMAN)
STLVSLFQSSPERTQSTF

SEQ ID NO: 254546 - protein, 19 aa, Homo sapiens
  Native (MAGC1_HUMAN)
STLVSLFQSSPERTQSTFE

SEQ ID NO: 254547 - protein, 20 aa, Homo sapiens
  Native (MAGC1_HUMAN)
STLVSLFQSSPERTQSTFEG

SEQ ID NO: 254548 - protein, 21 aa, Homo sapiens
  Native (MAGC1_HUMAN)
STLVSLFQSSPERTQSTFEGF

SEQ ID NO: 254549 - protein, 22 aa, Homo sapiens
  Native (MAGC1_HUMAN)
STLVSLFQSSPERTQSTFEGFP

SEQ ID NO: 254550 - protein, 23 aa, Homo sapiens
  Native (MAGC1_HUMAN)
STLVSLFQSSPERTQSTFEGFPQ

SEQ ID NO: 254551 - protein, 24 aa, Homo sapiens
  Native (MAGC1_HUMAN)
STLVSLFQSSPERTQSTFEGFPQS

SEQ ID NO: 254552 - protein, 25 aa, Homo sapiens
  Native (MAGC1_HUMAN)
STLVSLFQSSPERTQSTFEGFPQSP

SEQ ID NO: 254553 - protein, 15 aa, Homo sapiens
  Native (MAGC1_HUMAN)
STQSPFEGFPQSPLQ

SEQ ID NO: 254554 - protein, 16 aa, Homo sapiens
  Native (MAGC1_HUMAN)
STQSPFEGFPQSPLQI

SEQ ID NO: 254555 - protein, 17 aa, Homo sapiens
  Native (MAGC1_HUMAN)
STQSPFEGFPQSPLQIP

SEQ ID NO: 254556 - protein, 19 aa, Homo sapiens
  Native (MAGC1_HUMAN)
STQSPFEGFPQSPLQIPVS

SEQ ID NO: 254557 - protein, 20 aa, Homo sapiens
  Native (MAGC1_HUMAN)
STQSPFEGFPQSPLQIPVSR

SEQ ID NO: 254558 - protein, 21 aa, Homo sapiens
  Native (MAGC1_HUMAN)
STQSPFEGFPQSPLQIPVSRS

SEQ ID NO: 254559 - protein, 22 aa, Homo sapiens
  Native (MAGC1_HUMAN)
STQSPFEGFPQSPLQIPVSRSF

SEQ ID NO: 254560 - protein, 23 aa, Homo sapiens
  Native (MAGC1_HUMAN)
STQSPFEGFPQSPLQIPVSRSFS

SEQ ID NO: 254561 - protein, 24 aa, Homo sapiens
  Native (MAGC1_HUMAN)
STQSPFEGFPQSPLQIPVSRSFSS

SEQ ID NO: 254562 - protein, 25 aa, Homo sapiens
  Native (MAGC1_HUMAN)
STQSPFEGFPQSPLQIPVSRSFSST

SEQ ID NO: 254563 - protein, 14 aa, Homo sapiens
  Native (MAGC1_HUMAN)
STQSPFEGFPQSVL

SEQ ID NO: 254564 - protein, 15 aa, Homo sapiens
  Native (MAGC1_HUMAN)
STQSPFEGFPQSVLQ

SEQ ID NO: 254565 - protein, 16 aa, Homo sapiens
  Native (MAGC1_HUMAN)
STQSPFEGFPQSVLQI

SEQ ID NO: 254566 - protein, 17 aa, Homo sapiens
  Native (MAGC1_HUMAN)
STQSPFEGFPQSVLQIP

SEQ ID NO: 254567 - protein, 18 aa, Homo sapiens
  Native (MAGC1_HUMAN)
STQSPFEGFPQSVLQIPV

SEQ ID NO: 254568 - protein, 19 aa, Homo sapiens
  Native (MAGC1_HUMAN)
STQSPFEGFPQSVLQIPVS

SEQ ID NO: 254569 - protein, 20 aa, Homo sapiens
  Native (MAGC1_HUMAN)
STQSPFEGFPQSVLQIPVSA

SEQ ID NO: 254570 - protein, 21 aa, Homo sapiens
  Native (MAGC1_HUMAN)
STQSPFEGFPQSVLQIPVSAA

SEQ ID NO: 254571 - protein, 22 aa, Homo sapiens
  Native (MAGC1_HUMAN)
STQSPFEGFPQSVLQIPVSAAS

SEQ ID NO: 254572 - protein, 23 aa, Homo sapiens
  Native (MAGC1_HUMAN)
STQSPFEGFPQSVLQIPVSAASS

SEQ ID NO: 254573 - protein, 24 aa, Homo sapiens
  Native (MAGC1_HUMAN)
STQSPFEGFPQSVLQIPVSAASSS

SEQ ID NO: 254574 - protein, 25 aa, Homo sapiens
  Native (MAGC1_HUMAN)
STQSPFEGFPQSVLQIPVSAASSST

SEQ ID NO: 254575 - protein, 15 aa, Homo sapiens
  Native (MAGC1_HUMAN)
STSLSLPQSFPESPQ

SEQ ID NO: 254576 - protein, 20 aa, Homo sapiens
  Native (MAGC1_HUMAN)
STSLSPFSEESSSPVDEYTS

SEQ ID NO: 254577 - protein, 15 aa, Homo sapiens
  Native (MAGC1_HUMAN)
STSSSLSKSSPESPL

SEQ ID NO: 254578 - protein, 16 aa, Homo sapiens
  Native (MAGC1_HUMAN)
STSSSLSKSSPESPLQ

SEQ ID NO: 254579 - protein, 13 aa, Homo sapiens
  Native (MAGC1_HUMAN)
STSSSLSQSSPVS

SEQ ID NO: 254580 - protein, 14 aa, Homo sapiens
  Native (MAGC1_HUMAN)
STSSSLSQSSPVSS

SEQ ID NO: 254581 - protein, 15 aa, Homo sapiens
  Native (MAGC1_HUMAN)
STSSSLSQSSPVSSF

SEQ ID NO: 254582 - protein, 16 aa, Homo sapiens
  Native (MAGC1_HUMAN)
STSSSLSQSSPVSSFP

SEQ ID NO: 254583 - protein, 17 aa, Homo sapiens
  Native (MAGC1_HUMAN)
STSSSLSQSSPVSSFPS

SEQ ID NO: 254584 - protein, 18 aa, Homo sapiens
  Native (MAGC1_HUMAN)
STSSSLSQSSPVSSFPSS

SEQ ID NO: 254585 - protein, 19 aa, Homo sapiens
  Native (MAGC1_HUMAN)
STSSSLSQSSPVSSFPSST

SEQ ID NO: 254586 - protein, 20 aa, Homo sapiens
  Native (MAGC1_HUMAN)
STSSSLSQSSPVSSFPSSTS

SEQ ID NO: 254587 - protein, 21 aa, Homo sapiens
  Native (MAGC1_HUMAN)
STSSSLSQSSPVSSFPSSTSS

SEQ ID NO: 254588 - protein, 22 aa, Homo sapiens
  Native (MAGC1_HUMAN)
STSSSLSQSSPVSSFPSSTSSS

SEQ ID NO: 254589 - protein, 23 aa, Homo sapiens
  Native (MAGC1_HUMAN)
STSSSLSQSSPVSSFPSSTSSSL

SEQ ID NO: 254590 - protein, 24 aa, Homo sapiens
  Native (MAGC1_HUMAN)
STSSSLSQSSPVSSFPSSTSSSLS

SEQ ID NO: 254591 - protein, 25 aa, Homo sapiens
  Native (MAGC1_HUMAN)
STSSSLSQSSPVSSFPSSTSSSLSK

SEQ ID NO: 254592 - protein, 14 aa, Homo sapiens
  Native (MAGC1_HUMAN)
SVLQIPVSAASSST

SEQ ID NO: 254593 - protein, 15 aa, Homo sapiens
  Native (MAGC1_HUMAN)
SVLQIPVSAASSSTL

SEQ ID NO: 254594 - protein, 16 aa, Homo sapiens
  Native (MAGC1_HUMAN)
SVLQIPVSAASSSTLV

SEQ ID NO: 254595 - protein, 17 aa, Homo sapiens
  Native (MAGC1_HUMAN)
SVLQIPVSAASSSTLVS

SEQ ID NO: 254596 - protein, 18 aa, Homo sapiens
  Native (MAGC1_HUMAN)
SVLQIPVSAASSSTLVSI

SEQ ID NO: 254597 - protein, 19 aa, Homo sapiens
  Native (MAGC1_HUMAN)
SVLQIPVSAASSSTLVSIF

SEQ ID NO: 254598 - protein, 20 aa, Homo sapiens
  Native (MAGC1_HUMAN)
SVLQIPVSAASSSTLVSIFQ

SEQ ID NO: 254599 - protein, 21 aa, Homo sapiens
  Native (MAGC1_HUMAN)
SVLQIPVSAASSSTLVSIFQS

SEQ ID NO: 254600 - protein, 22 aa, Homo sapiens
  Native (MAGC1_HUMAN)
SVLQIPVSAASSSTLVSIFQSS

SEQ ID NO: 254601 - protein, 23 aa, Homo sapiens
  Native (MAGC1_HUMAN)
SVLQIPVSAASSSTLVSIFQSSP

SEQ ID NO: 254602 - protein, 24 aa, Homo sapiens
  Native (MAGC1_HUMAN)
SVLQIPVSAASSSTLVSIFQSSPE

SEQ ID NO: 254603 - protein, 25 aa, Homo sapiens
  Native (MAGC1_HUMAN)
SVLQIPVSAASSSTLVSIFQSSPES

SEQ ID NO: 254604 - protein, 25 aa, Homo sapiens
  Native (MAGC1_HUMAN)
SYKDALKDVEERAQAIIDTTDDSTA

SEQ ID NO: 254605 - protein, 13 aa, Homo sapiens
  Native (MAGC1_HUMAN)
SYTLASLLQSSHE

SEQ ID NO: 254606 - protein, 14 aa, Homo sapiens
  Native (MAGC1_HUMAN)
SYTLASLLQSSHES

SEQ ID NO: 254607 - protein, 15 aa, Homo sapiens
  Native (MAGC1_HUMAN)
SYTLASLLQSSHESP

SEQ ID NO: 254608 - protein, 16 aa, Homo sapiens
  Native (MAGC1_HUMAN)
SYTLASLLQSSHESPQ

SEQ ID NO: 254609 - protein, 17 aa, Homo sapiens
  Native (MAGC1_HUMAN)
SYTLASLLQSSHESPQS

SEQ ID NO: 254610 - protein, 18 aa, Homo sapiens
  Native (MAGC1_HUMAN)
SYTLASLLQSSHESPQSP

SEQ ID NO: 254611 - protein, 19 aa, Homo sapiens
  Native (MAGC1_HUMAN)
SYTLASLLQSSHESPQSPP

SEQ ID NO: 254612 - protein, 20 aa, Homo sapiens
  Native (MAGC1_HUMAN)
SYTLASLLQSSHESPQSPPE

SEQ ID NO: 254613 - protein, 21 aa, Homo sapiens
  Native (MAGC1_HUMAN)
SYTLASLLQSSHESPQSPPEG

SEQ ID NO: 254614 - protein, 22 aa, Homo sapiens
  Native (MAGC1_HUMAN)
SYTLASLLQSSHESPQSPPEGP

SEQ ID NO: 254615 - protein, 23 aa, Homo sapiens
  Native (MAGC1_HUMAN)
SYTLASLLQSSHESPQSPPEGPA

SEQ ID NO: 254616 - protein, 24 aa, Homo sapiens
  Native (MAGC1_HUMAN)
SYTLASLLQSSHESPQSPPEGPAQ

SEQ ID NO: 254617 - protein, 25 aa, Homo sapiens
  Native (MAGC1_HUMAN)
SYTLASLLQSSHESPQSPPEGPAQS

SEQ ID NO: 254618 - protein, 13 aa, Homo sapiens
  Native (MAGC1_HUMAN)
SYTLLSLFQSSPE

SEQ ID NO: 254619 - protein, 14 aa, Homo sapiens
  Native (MAGC1_HUMAN)
SYTLLSLFQSSPER

SEQ ID NO: 254620 - protein, 15 aa, Homo sapiens
  Native (MAGC1_HUMAN)
SYTLLSLFQSSPERT

SEQ ID NO: 254621 - protein, 16 aa, Homo sapiens
  Native (MAGC1_HUMAN)
SYTLLSLFQSSPERTH

SEQ ID NO: 254622 - protein, 17 aa, Homo sapiens
  Native (MAGC1_HUMAN)
SYTLLSLFQSSPERTHS

SEQ ID NO: 254623 - protein, 18 aa, Homo sapiens
  Native (MAGC1_HUMAN)
SYTLLSLFQSSPERTHST

SEQ ID NO: 254624 - protein, 19 aa, Homo sapiens
  Native (MAGC1_HUMAN)
SYTLLSLFQSSPERTHSTF

SEQ ID NO: 254625 - protein, 20 aa, Homo sapiens
  Native (MAGC1_HUMAN)
SYTLLSLFQSSPERTHSTFE

SEQ ID NO: 254626 - protein, 21 aa, Homo sapiens
  Native (MAGC1_HUMAN)
SYTLLSLFQSSPERTHSTFEG

SEQ ID NO: 254627 - protein, 22 aa, Homo sapiens
  Native (MAGC1_HUMAN)
SYTLLSLFQSSPERTHSTFEGF

SEQ ID NO: 254628 - protein, 23 aa, Homo sapiens
  Native (MAGC1_HUMAN)
SYTLLSLFQSSPERTHSTFEGFP

SEQ ID NO: 254629 - protein, 24 aa, Homo sapiens
  Native (MAGC1_HUMAN)
SYTLLSLFQSSPERTHSTFEGFPQ

SEQ ID NO: 254630 - protein, 25 aa, Homo sapiens
  Native (MAGC1_HUMAN)
SYTLLSLFQSSPERTHSTFEGFPQS

SEQ ID NO: 254631 - protein, 13 aa, Homo sapiens
  Native (MAGC1_HUMAN)
SYVFVNTLDLTSE

SEQ ID NO: 254632 - protein, 14 aa, Homo sapiens
  Native (MAGC1_HUMAN)
SYVFVNTLDLTSEG

SEQ ID NO: 254633 - protein, 15 aa, Homo sapiens
  Native (MAGC1_HUMAN)
SYVFVNTLDLTSEGC

SEQ ID NO: 254634 - protein, 16 aa, Homo sapiens
  Native (MAGC1_HUMAN)
SYVFVNTLDLTSEGCL

SEQ ID NO: 254635 - protein, 17 aa, Homo sapiens
  Native (MAGC1_HUMAN)
SYVFVNTLDLTSEGCLS

SEQ ID NO: 254636 - protein, 18 aa, Homo sapiens
  Native (MAGC1_HUMAN)
SYVFVNTLDLTSEGCLSD

SEQ ID NO: 254637 - protein, 19 aa, Homo sapiens
  Native (MAGC1_HUMAN)
SYVFVNTLDLTSEGCLSDE

SEQ ID NO: 254638 - protein, 20 aa, Homo sapiens
  Native (MAGC1_HUMAN)
SYVFVNTLDLTSEGCLSDEQ

SEQ ID NO: 254639 - protein, 21 aa, Homo sapiens
  Native (MAGC1_HUMAN)
SYVFVNTLDLTSEGCLSDEQG

SEQ ID NO: 254640 - protein, 22 aa, Homo sapiens
  Native (MAGC1_HUMAN)
SYVFVNTLDLTSEGCLSDEQGM

SEQ ID NO: 254641 - protein, 23 aa, Homo sapiens
  Native (MAGC1_HUMAN)
SYVFVNTLDLTSEGCLSDEQGMS

SEQ ID NO: 254642 - protein, 24 aa, Homo sapiens
  Native (MAGC1_HUMAN)
SYVFVNTLDLTSEGCLSDEQGMSQ

SEQ ID NO: 254643 - protein, 25 aa, Homo sapiens
  Native (MAGC1_HUMAN)
SYVFVNTLDLTSEGCLSDEQGMSQN

SEQ ID NO: 254644 - protein, 15 aa, Homo sapiens
  Native (MAGC1_HUMAN)
TAGMPSLLQSSSESP

SEQ ID NO: 254645 - protein, 16 aa, Homo sapiens
  Native (MAGC1_HUMAN)
TAGMPSLLQSSSESPQ

SEQ ID NO: 254646 - protein, 13 aa, Homo sapiens
  Native (MAGC1_HUMAN)
TATESASSSVMSP

SEQ ID NO: 254647 - protein, 14 aa, Homo sapiens
  Native (MAGC1_HUMAN)
TATESASSSVMSPS

SEQ ID NO: 254648 - protein, 15 aa, Homo sapiens
  Native (MAGC1_HUMAN)
TATESASSSVMSPSF

SEQ ID NO: 254649 - protein, 16 aa, Homo sapiens
  Native (MAGC1_HUMAN)
TATESASSSVMSPSFS

SEQ ID NO: 254650 - protein, 17 aa, Homo sapiens
  Native (MAGC1_HUMAN)
TATESASSSVMSPSFSS

SEQ ID NO: 254651 - protein, 18 aa, Homo sapiens
  Native (MAGC1_HUMAN)
TATESASSSVMSPSFSSE

SEQ ID NO: 254652 - protein, 14 aa, Homo sapiens
  Native (MAGC1_HUMAN)
TDDSTATESASSSV

SEQ ID NO: 254653 - protein, 15 aa, Homo sapiens
  Native (MAGC1_HUMAN)
TDDSTATESASSSVM

SEQ ID NO: 254654 - protein, 16 aa, Homo sapiens
  Native (MAGC1_HUMAN)
TDDSTATESASSSVMS

SEQ ID NO: 254655 - protein, 17 aa, Homo sapiens
  Native (MAGC1_HUMAN)
TDDSTATESASSSVMSP

SEQ ID NO: 254656 - protein, 18 aa, Homo sapiens
  Native (MAGC1_HUMAN)
TDDSTATESASSSVMSPS

SEQ ID NO: 254657 - protein, 19 aa, Homo sapiens
  Native (MAGC1_HUMAN)
TDDSTATESASSSVMSPSF

SEQ ID NO: 254658 - protein, 20 aa, Homo sapiens
  Native (MAGC1_HUMAN)
TDDSTATESASSSVMSPSFS

SEQ ID NO: 254659 - protein, 21 aa, Homo sapiens
  Native (MAGC1_HUMAN)
TDDSTATESASSSVMSPSFSS

SEQ ID NO: 254660 - protein, 22 aa, Homo sapiens
  Native (MAGC1_HUMAN)
TDDSTATESASSSVMSPSFSSE

SEQ ID NO: 254661 - protein, 14 aa, Homo sapiens
  Native (MAGC1_HUMAN)
TDSESLIESEPLFT

SEQ ID NO: 254662 - protein, 15 aa, Homo sapiens
  Native (MAGC1_HUMAN)
TDSESLIESEPLFTY

SEQ ID NO: 254663 - protein, 16 aa, Homo sapiens
  Native (MAGC1_HUMAN)
TDSESLIESEPLFTYT

SEQ ID NO: 254664 - protein, 17 aa, Homo sapiens
  Native (MAGC1_HUMAN)
TDSESLIESEPLFTYTL

SEQ ID NO: 254665 - protein, 18 aa, Homo sapiens
  Native (MAGC1_HUMAN)
TDSESLIESEPLFTYTLD

SEQ ID NO: 254666 - protein, 19 aa, Homo sapiens
  Native (MAGC1_HUMAN)
TDSESLIESEPLFTYTLDE

SEQ ID NO: 254667 - protein, 20 aa, Homo sapiens
  Native (MAGC1_HUMAN)
TDSESLIESEPLFTYTLDEK

SEQ ID NO: 254668 - protein, 21 aa, Homo sapiens
  Native (MAGC1_HUMAN)
TDSESLIESEPLFTYTLDEKV

SEQ ID NO: 254669 - protein, 22 aa, Homo sapiens
  Native (MAGC1_HUMAN)
TDSESLIESEPLFTYTLDEKVD

SEQ ID NO: 254670 - protein, 23 aa, Homo sapiens
  Native (MAGC1_HUMAN)
TDSESLIESEPLFTYTLDEKVDE

SEQ ID NO: 254671 - protein, 24 aa, Homo sapiens
  Native (MAGC1_HUMAN)
TDSESLIESEPLFTYTLDEKVDEL

SEQ ID NO: 254672 - protein, 13 aa, Homo sapiens
  Native (MAGC1_HUMAN)
TESASSSVMSPSF

SEQ ID NO: 254673 - protein, 14 aa, Homo sapiens
  Native (MAGC1_HUMAN)
TESASSSVMSPSFS

SEQ ID NO: 254674 - protein, 15 aa, Homo sapiens
  Native (MAGC1_HUMAN)
TESASSSVMSPSFSS

SEQ ID NO: 254675 - protein, 16 aa, Homo sapiens
  Native (MAGC1_HUMAN)
TESASSSVMSPSFSSE

SEQ ID NO: 254676 - protein, 13 aa, Homo sapiens
  Native (MAGC1_HUMAN)
TFEGFAQSPLQIP

SEQ ID NO: 254677 - protein, 14 aa, Homo sapiens
  Native (MAGC1_HUMAN)
TFEGFAQSPLQIPV

SEQ ID NO: 254678 - protein, 15 aa, Homo sapiens
  Native (MAGC1_HUMAN)
TFEGFAQSPLQIPVS

SEQ ID NO: 254679 - protein, 16 aa, Homo sapiens
  Native (MAGC1_HUMAN)
TFEGFAQSPLQIPVSP

SEQ ID NO: 254680 - protein, 17 aa, Homo sapiens
  Native (MAGC1_HUMAN)
TFEGFAQSPLQIPVSPS

SEQ ID NO: 254681 - protein, 18 aa, Homo sapiens
  Native (MAGC1_HUMAN)
TFEGFAQSPLQIPVSPSS

SEQ ID NO: 254682 - protein, 19 aa, Homo sapiens
  Native (MAGC1_HUMAN)
TFEGFAQSPLQIPVSPSSS

SEQ ID NO: 254683 - protein, 20 aa, Homo sapiens
  Native (MAGC1_HUMAN)
TFEGFAQSPLQIPVSPSSSS

SEQ ID NO: 254684 - protein, 21 aa, Homo sapiens
  Native (MAGC1_HUMAN)
TFEGFAQSPLQIPVSPSSSST

SEQ ID NO: 254685 - protein, 22 aa, Homo sapiens
  Native (MAGC1_HUMAN)
TFEGFAQSPLQIPVSPSSSSTL

SEQ ID NO: 254686 - protein, 23 aa, Homo sapiens
  Native (MAGC1_HUMAN)
TFEGFAQSPLQIPVSPSSSSTLL

SEQ ID NO: 254687 - protein, 24 aa, Homo sapiens
  Native (MAGC1_HUMAN)
TFEGFAQSPLQIPVSPSSSSTLLS

SEQ ID NO: 254688 - protein, 25 aa, Homo sapiens
  Native (MAGC1_HUMAN)
TFEGFAQSPLQIPVSPSSSSTLLSL

SEQ ID NO: 254689 - protein, 13 aa, Homo sapiens
  Native (MAGC1_HUMAN)
TFEGFAQSSLQIP

SEQ ID NO: 254690 - protein, 14 aa, Homo sapiens
  Native (MAGC1_HUMAN)
TFEGFAQSSLQIPV

SEQ ID NO: 254691 - protein, 15 aa, Homo sapiens
  Native (MAGC1_HUMAN)
TFEGFAQSSLQIPVS

SEQ ID NO: 254692 - protein, 16 aa, Homo sapiens
  Native (MAGC1_HUMAN)
TFEGFAQSSLQIPVSP

SEQ ID NO: 254693 - protein, 17 aa, Homo sapiens
  Native (MAGC1_HUMAN)
TFEGFAQSSLQIPVSPS

SEQ ID NO: 254694 - protein, 18 aa, Homo sapiens
  Native (MAGC1_HUMAN)
TFEGFAQSSLQIPVSPSF

SEQ ID NO: 254695 - protein, 19 aa, Homo sapiens
  Native (MAGC1_HUMAN)
TFEGFAQSSLQIPVSPSFS

SEQ ID NO: 254696 - protein, 20 aa, Homo sapiens
  Native (MAGC1_HUMAN)
TFEGFAQSSLQIPVSPSFSS

SEQ ID NO: 254697 - protein, 21 aa, Homo sapiens
  Native (MAGC1_HUMAN)
TFEGFAQSSLQIPVSPSFSST

SEQ ID NO: 254698 - protein, 22 aa, Homo sapiens
  Native (MAGC1_HUMAN)
TFEGFAQSSLQIPVSPSFSSTL

SEQ ID NO: 254699 - protein, 23 aa, Homo sapiens
  Native (MAGC1_HUMAN)
TFEGFAQSSLQIPVSPSFSSTLV

SEQ ID NO: 254700 - protein, 24 aa, Homo sapiens
  Native (MAGC1_HUMAN)
TFEGFAQSSLQIPVSPSFSSTLVS

SEQ ID NO: 254701 - protein, 25 aa, Homo sapiens
  Native (MAGC1_HUMAN)
TFEGFAQSSLQIPVSPSFSSTLVSL

SEQ ID NO: 254702 - protein, 14 aa, Homo sapiens
  Native (MAGC1_HUMAN)
TFEGFPQSLLQIPM

SEQ ID NO: 254703 - protein, 15 aa, Homo sapiens
  Native (MAGC1_HUMAN)
TFEGFPQSLLQIPMT

SEQ ID NO: 254704 - protein, 16 aa, Homo sapiens
  Native (MAGC1_HUMAN)
TFEGFPQSLLQIPMTS

SEQ ID NO: 254705 - protein, 17 aa, Homo sapiens
  Native (MAGC1_HUMAN)
TFEGFPQSLLQIPMTSS

SEQ ID NO: 254706 - protein, 18 aa, Homo sapiens
  Native (MAGC1_HUMAN)
TFEGFPQSLLQIPMTSSF

SEQ ID NO: 254707 - protein, 19 aa, Homo sapiens
  Native (MAGC1_HUMAN)
TFEGFPQSLLQIPMTSSFS

SEQ ID NO: 254708 - protein, 20 aa, Homo sapiens
  Native (MAGC1_HUMAN)
TFEGFPQSLLQIPMTSSFSS

SEQ ID NO: 254709 - protein, 21 aa, Homo sapiens
  Native (MAGC1_HUMAN)
TFEGFPQSLLQIPMTSSFSST

SEQ ID NO: 254710 - protein, 22 aa, Homo sapiens
  Native (MAGC1_HUMAN)
TFEGFPQSLLQIPMTSSFSSTL

SEQ ID NO: 254711 - protein, 23 aa, Homo sapiens
  Native (MAGC1_HUMAN)
TFEGFPQSLLQIPMTSSFSSTLL

SEQ ID NO: 254712 - protein, 24 aa, Homo sapiens
  Native (MAGC1_HUMAN)
TFEGFPQSLLQIPMTSSFSSTLLS

SEQ ID NO: 254713 - protein, 25 aa, Homo sapiens
  Native (MAGC1_HUMAN)
TFEGFPQSLLQIPMTSSFSSTLLSI

SEQ ID NO: 254714 - protein, 20 aa, Homo sapiens
  Native (MAGC1_HUMAN)
TFEGFPQSPLQIPGSPSFSS

SEQ ID NO: 254715 - protein, 22 aa, Homo sapiens
  Native (MAGC1_HUMAN)
TFEGFPQSPLQIPGSPSFSSTL

SEQ ID NO: 254716 - protein, 23 aa, Homo sapiens
  Native (MAGC1_HUMAN)
TFEGFPQSPLQIPGSPSFSSTLL

SEQ ID NO: 254717 - protein, 24 aa, Homo sapiens
  Native (MAGC1_HUMAN)
TFEGFPQSPLQIPGSPSFSSTLLS

SEQ ID NO: 254718 - protein, 25 aa, Homo sapiens
  Native (MAGC1_HUMAN)
TFEGFPQSPLQIPGSPSFSSTLLSL

SEQ ID NO: 254719 - protein, 15 aa, Homo sapiens
  Native (MAGC1_HUMAN)
TFEGFPQSPLQIPMT

SEQ ID NO: 254720 - protein, 16 aa, Homo sapiens
  Native (MAGC1_HUMAN)
TFEGFPQSPLQIPMTS

SEQ ID NO: 254721 - protein, 17 aa, Homo sapiens
  Native (MAGC1_HUMAN)
TFEGFPQSPLQIPMTSS

SEQ ID NO: 254722 - protein, 19 aa, Homo sapiens
  Native (MAGC1_HUMAN)
TFEGFPQSPLQIPMTSSFS

SEQ ID NO: 254723 - protein, 20 aa, Homo sapiens
  Native (MAGC1_HUMAN)
TFEGFPQSPLQIPMTSSFSS

SEQ ID NO: 254724 - protein, 21 aa, Homo sapiens
  Native (MAGC1_HUMAN)
TFEGFPQSPLQIPMTSSFSST

SEQ ID NO: 254725 - protein, 22 aa, Homo sapiens
  Native (MAGC1_HUMAN)
TFEGFPQSPLQIPMTSSFSSTL

SEQ ID NO: 254726 - protein, 23 aa, Homo sapiens
  Native (MAGC1_HUMAN)
TFEGFPQSPLQIPMTSSFSSTLL

SEQ ID NO: 254727 - protein, 24 aa, Homo sapiens
  Native (MAGC1_HUMAN)
TFEGFPQSPLQIPMTSSFSSTLLS

SEQ ID NO: 254728 - protein, 25 aa, Homo sapiens
  Native (MAGC1_HUMAN)
TFEGFPQSPLQIPMTSSFSSTLLSI

SEQ ID NO: 254729 - protein, 15 aa, Homo sapiens
  Native (MAGC1_HUMAN)
TFEGFPQSPLQIPQS

SEQ ID NO: 254730 - protein, 20 aa, Homo sapiens
  Native (MAGC1_HUMAN)
TFEGFPQSPLQIPQSPPEGE

SEQ ID NO: 254731 - protein, 15 aa, Homo sapiens
  Native (MAGC1_HUMAN)
TFEGFPQSPLQIPVS

SEQ ID NO: 254732 - protein, 16 aa, Homo sapiens
  Native (MAGC1_HUMAN)
TFEGFPQSPLQIPVSS

SEQ ID NO: 254733 - protein, 17 aa, Homo sapiens
  Native (MAGC1_HUMAN)
TFEGFPQSPLQIPVSSS

SEQ ID NO: 254734 - protein, 20 aa, Homo sapiens
  Native (MAGC1_HUMAN)
TFEGFPQSPLQIPVSSSSSS

SEQ ID NO: 254735 - protein, 22 aa, Homo sapiens
  Native (MAGC1_HUMAN)
TFEGFPQSPLQIPVSSSSSSST

SEQ ID NO: 254736 - protein, 23 aa, Homo sapiens
  Native (MAGC1_HUMAN)
TFEGFPQSPLQIPVSSSSSSSTL

SEQ ID NO: 254737 - protein, 24 aa, Homo sapiens
  Native (MAGC1_HUMAN)
TFEGFPQSPLQIPVSSSSSSSTLL

SEQ ID NO: 254738 - protein, 25 aa, Homo sapiens
  Native (MAGC1_HUMAN)
TFEGFPQSPLQIPVSSSSSSSTLLS

SEQ ID NO: 254739 - protein, 22 aa, Homo sapiens
  Native (MAGC1_HUMAN)
TFEGFPQSPLQIPVSSSSSSTL

SEQ ID NO: 254740 - protein, 23 aa, Homo sapiens
  Native (MAGC1_HUMAN)
TFEGFPQSPLQIPVSSSSSSTLL

SEQ ID NO: 254741 - protein, 24 aa, Homo sapiens
  Native (MAGC1_HUMAN)
TFEGFPQSPLQIPVSSSSSSTLLS

SEQ ID NO: 254742 - protein, 25 aa, Homo sapiens
  Native (MAGC1_HUMAN)
TFEGFPQSPLQIPVSSSSSSTLLSL

SEQ ID NO: 254743 - protein, 13 aa, Homo sapiens
  Native (MAGC1_HUMAN)
TGYFPVIFRKARE

SEQ ID NO: 254744 - protein, 14 aa, Homo sapiens
  Native (MAGC1_HUMAN)
TGYFPVIFRKAREF

SEQ ID NO: 254745 - protein, 15 aa, Homo sapiens
  Native (MAGC1_HUMAN)
TGYFPVIFRKAREFI

SEQ ID NO: 254746 - protein, 16 aa, Homo sapiens
  Native (MAGC1_HUMAN)
TGYFPVIFRKAREFIE

SEQ ID NO: 254747 - protein, 17 aa, Homo sapiens
  Native (MAGC1_HUMAN)
TGYFPVIFRKAREFIEI

SEQ ID NO: 254748 - protein, 18 aa, Homo sapiens
  Native (MAGC1_HUMAN)
TGYFPVIFRKAREFIEIL

SEQ ID NO: 254749 - protein, 19 aa, Homo sapiens
  Native (MAGC1_HUMAN)
TGYFPVIFRKAREFIEILF

SEQ ID NO: 254750 - protein, 20 aa, Homo sapiens
  Native (MAGC1_HUMAN)
TGYFPVIFRKAREFIEILFG

SEQ ID NO: 254751 - protein, 21 aa, Homo sapiens
  Native (MAGC1_HUMAN)
TGYFPVIFRKAREFIEILFGI

SEQ ID NO: 254752 - protein, 22 aa, Homo sapiens
  Native (MAGC1_HUMAN)
TGYFPVIFRKAREFIEILFGIS

SEQ ID NO: 254753 - protein, 23 aa, Homo sapiens
  Native (MAGC1_HUMAN)
TGYFPVIFRKAREFIEILFGISL

SEQ ID NO: 254754 - protein, 24 aa, Homo sapiens
  Native (MAGC1_HUMAN)
TGYFPVIFRKAREFIEILFGISLR

SEQ ID NO: 254755 - protein, 25 aa, Homo sapiens
  Native (MAGC1_HUMAN)
TGYFPVIFRKAREFIEILFGISLRE

SEQ ID NO: 254756 - protein, 13 aa, Homo sapiens
  Native (MAGC1_HUMAN)
THSPLQIVPSLPE

SEQ ID NO: 254757 - protein, 14 aa, Homo sapiens
  Native (MAGC1_HUMAN)
THSPLQIVPSLPEW

SEQ ID NO: 254758 - protein, 15 aa, Homo sapiens
  Native (MAGC1_HUMAN)
THSPLQIVPSLPEWE

SEQ ID NO: 254759 - protein, 16 aa, Homo sapiens
  Native (MAGC1_HUMAN)
THSPLQIVPSLPEWED

SEQ ID NO: 254760 - protein, 17 aa, Homo sapiens
  Native (MAGC1_HUMAN)
THSPLQIVPSLPEWEDS

SEQ ID NO: 254761 - protein, 18 aa, Homo sapiens
  Native (MAGC1_HUMAN)
THSPLQIVPSLPEWEDSL

SEQ ID NO: 254762 - protein, 19 aa, Homo sapiens
  Native (MAGC1_HUMAN)
THSPLQIVPSLPEWEDSLS

SEQ ID NO: 254763 - protein, 20 aa, Homo sapiens
  Native (MAGC1_HUMAN)
THSPLQIVPSLPEWEDSLSP

SEQ ID NO: 254764 - protein, 21 aa, Homo sapiens
  Native (MAGC1_HUMAN)
THSPLQIVPSLPEWEDSLSPH

SEQ ID NO: 254765 - protein, 22 aa, Homo sapiens
  Native (MAGC1_HUMAN)
THSPLQIVPSLPEWEDSLSPHY

SEQ ID NO: 254766 - protein, 23 aa, Homo sapiens
  Native (MAGC1_HUMAN)
THSPLQIVPSLPEWEDSLSPHYF

SEQ ID NO: 254767 - protein, 24 aa, Homo sapiens
  Native (MAGC1_HUMAN)
THSPLQIVPSLPEWEDSLSPHYFP

SEQ ID NO: 254768 - protein, 25 aa, Homo sapiens
  Native (MAGC1_HUMAN)
THSPLQIVPSLPEWEDSLSPHYFPQ

SEQ ID NO: 254769 - protein, 14 aa, Homo sapiens
  Native (MAGC1_HUMAN)
THSTFEGFPQSLLQ

SEQ ID NO: 254770 - protein, 15 aa, Homo sapiens
  Native (MAGC1_HUMAN)
THSTFEGFPQSLLQI

SEQ ID NO: 254771 - protein, 16 aa, Homo sapiens
  Native (MAGC1_HUMAN)
THSTFEGFPQSLLQIP

SEQ ID NO: 254772 - protein, 17 aa, Homo sapiens
  Native (MAGC1_HUMAN)
THSTFEGFPQSLLQIPM

SEQ ID NO: 254773 - protein, 18 aa, Homo sapiens
  Native (MAGC1_HUMAN)
THSTFEGFPQSLLQIPMT

SEQ ID NO: 254774 - protein, 19 aa, Homo sapiens
  Native (MAGC1_HUMAN)
THSTFEGFPQSLLQIPMTS

SEQ ID NO: 254775 - protein, 20 aa, Homo sapiens
  Native (MAGC1_HUMAN)
THSTFEGFPQSLLQIPMTSS

SEQ ID NO: 254776 - protein, 21 aa, Homo sapiens
  Native (MAGC1_HUMAN)
THSTFEGFPQSLLQIPMTSSF

SEQ ID NO: 254777 - protein, 22 aa, Homo sapiens
  Native (MAGC1_HUMAN)
THSTFEGFPQSLLQIPMTSSFS

SEQ ID NO: 254778 - protein, 23 aa, Homo sapiens
  Native (MAGC1_HUMAN)
THSTFEGFPQSLLQIPMTSSFSS

SEQ ID NO: 254779 - protein, 24 aa, Homo sapiens
  Native (MAGC1_HUMAN)
THSTFEGFPQSLLQIPMTSSFSST

SEQ ID NO: 254780 - protein, 25 aa, Homo sapiens
  Native (MAGC1_HUMAN)
THSTFEGFPQSLLQIPMTSSFSSTL

SEQ ID NO: 254781 - protein, 15 aa, Homo sapiens
  Native (MAGC1_HUMAN)
THSTFEGFPQSPLQI

SEQ ID NO: 254782 - protein, 16 aa, Homo sapiens
  Native (MAGC1_HUMAN)
THSTFEGFPQSPLQIP

SEQ ID NO: 254783 - protein, 17 aa, Homo sapiens
  Native (MAGC1_HUMAN)
THSTFEGFPQSPLQIPM

SEQ ID NO: 254784 - protein, 19 aa, Homo sapiens
  Native (MAGC1_HUMAN)
THSTFEGFPQSPLQIPMTS

SEQ ID NO: 254785 - protein, 20 aa, Homo sapiens
  Native (MAGC1_HUMAN)
THSTFEGFPQSPLQIPMTSS

SEQ ID NO: 254786 - protein, 21 aa, Homo sapiens
  Native (MAGC1_HUMAN)
THSTFEGFPQSPLQIPMTSSF

SEQ ID NO: 254787 - protein, 22 aa, Homo sapiens
  Native (MAGC1_HUMAN)
THSTFEGFPQSPLQIPMTSSFS

SEQ ID NO: 254788 - protein, 23 aa, Homo sapiens
  Native (MAGC1_HUMAN)
THSTFEGFPQSPLQIPMTSSFSS

SEQ ID NO: 254789 - protein, 24 aa, Homo sapiens
  Native (MAGC1_HUMAN)
THSTFEGFPQSPLQIPMTSSFSST

SEQ ID NO: 254790 - protein, 25 aa, Homo sapiens
  Native (MAGC1_HUMAN)
THSTFEGFPQSPLQIPMTSSFSSTL

SEQ ID NO: 254791 - protein, 17 aa, Homo sapiens
  Native (MAGC1_HUMAN)
THSTFEGFPQSPLQIPV

SEQ ID NO: 254792 - protein, 19 aa, Homo sapiens
  Native (MAGC1_HUMAN)
THSTFEGFPQSPLQIPVSS

SEQ ID NO: 254793 - protein, 20 aa, Homo sapiens
  Native (MAGC1_HUMAN)
THSTFEGFPQSPLQIPVSSS

SEQ ID NO: 254794 - protein, 21 aa, Homo sapiens
  Native (MAGC1_HUMAN)
THSTFEGFPQSPLQIPVSSSS

SEQ ID NO: 254795 - protein, 22 aa, Homo sapiens
  Native (MAGC1_HUMAN)
THSTFEGFPQSPLQIPVSSSSS

SEQ ID NO: 254796 - protein, 23 aa, Homo sapiens
  Native (MAGC1_HUMAN)
THSTFEGFPQSPLQIPVSSSSSS

SEQ ID NO: 254797 - protein, 24 aa, Homo sapiens
  Native (MAGC1_HUMAN)
THSTFEGFPQSPLQIPVSSSSSSS

SEQ ID NO: 254798 - protein, 25 aa, Homo sapiens
  Native (MAGC1_HUMAN)
THSTFEGFPQSPLQIPVSSSSSSST

SEQ ID NO: 254799 - protein, 13 aa, Homo sapiens
  Native (MAGC1_HUMAN)
TKAEMLTNVISRY

SEQ ID NO: 254800 - protein, 14 aa, Homo sapiens
  Native (MAGC1_HUMAN)
TKAEMLTNVISRYT

SEQ ID NO: 254801 - protein, 15 aa, Homo sapiens
  Native (MAGC1_HUMAN)
TKAEMLTNVISRYTG

SEQ ID NO: 254802 - protein, 16 aa, Homo sapiens
  Native (MAGC1_HUMAN)
TKAEMLTNVISRYTGY

SEQ ID NO: 254803 - protein, 17 aa, Homo sapiens
  Native (MAGC1_HUMAN)
TKAEMLTNVISRYTGYF

SEQ ID NO: 254804 - protein, 18 aa, Homo sapiens
  Native (MAGC1_HUMAN)
TKAEMLTNVISRYTGYFP

SEQ ID NO: 254805 - protein, 19 aa, Homo sapiens
  Native (MAGC1_HUMAN)
TKAEMLTNVISRYTGYFPV

SEQ ID NO: 254806 - protein, 20 aa, Homo sapiens
  Native (MAGC1_HUMAN)
TKAEMLTNVISRYTGYFPVI

SEQ ID NO: 254807 - protein, 21 aa, Homo sapiens
  Native (MAGC1_HUMAN)
TKAEMLTNVISRYTGYFPVIF

SEQ ID NO: 254808 - protein, 22 aa, Homo sapiens
  Native (MAGC1_HUMAN)
TKAEMLTNVISRYTGYFPVIFR

SEQ ID NO: 254809 - protein, 23 aa, Homo sapiens
  Native (MAGC1_HUMAN)
TKAEMLTNVISRYTGYFPVIFRK

SEQ ID NO: 254810 - protein, 24 aa, Homo sapiens
  Native (MAGC1_HUMAN)
TKAEMLTNVISRYTGYFPVIFRKA

SEQ ID NO: 254811 - protein, 25 aa, Homo sapiens
  Native (MAGC1_HUMAN)
TKAEMLTNVISRYTGYFPVIFRKAR

SEQ ID NO: 254812 - protein, 13 aa, Homo sapiens
  Native (MAGC1_HUMAN)
TKVWVQEHYLEYR

SEQ ID NO: 254813 - protein, 14 aa, Homo sapiens
  Native (MAGC1_HUMAN)
TKVWVQEHYLEYRE

SEQ ID NO: 254814 - protein, 15 aa, Homo sapiens
  Native (MAGC1_HUMAN)
TKVWVQEHYLEYREV

SEQ ID NO: 254815 - protein, 16 aa, Homo sapiens
  Native (MAGC1_HUMAN)
TKVWVQEHYLEYREVP

SEQ ID NO: 254816 - protein, 17 aa, Homo sapiens
  Native (MAGC1_HUMAN)
TKVWVQEHYLEYREVPN

SEQ ID NO: 254817 - protein, 18 aa, Homo sapiens
  Native (MAGC1_HUMAN)
TKVWVQEHYLEYREVPNS

SEQ ID NO: 254818 - protein, 19 aa, Homo sapiens
  Native (MAGC1_HUMAN)
TKVWVQEHYLEYREVPNSS

SEQ ID NO: 254819 - protein, 21 aa, Homo sapiens
  Native (MAGC1_HUMAN)
TKVWVQEHYLEYREVPNSSPP

SEQ ID NO: 254820 - protein, 22 aa, Homo sapiens
  Native (MAGC1_HUMAN)
TKVWVQEHYLEYREVPNSSPPR

SEQ ID NO: 254821 - protein, 23 aa, Homo sapiens
  Native (MAGC1_HUMAN)
TKVWVQEHYLEYREVPNSSPPRY

SEQ ID NO: 254822 - protein, 24 aa, Homo sapiens
  Native (MAGC1_HUMAN)
TKVWVQEHYLEYREVPNSSPPRYE

SEQ ID NO: 254823 - protein, 25 aa, Homo sapiens
  Native (MAGC1_HUMAN)
TKVWVQEHYLEYREVPNSSPPRYEF

SEQ ID NO: 254824 - protein, 15 aa, Homo sapiens
  Native (MAGC1_HUMAN)
TLASLLQSSHESPQS

SEQ ID NO: 254825 - protein, 15 aa, Homo sapiens
  Native (MAGC1_HUMAN)
TLDEKVDELARFLLL

SEQ ID NO: 254826 - protein, 16 aa, Homo sapiens
  Native (MAGC1_HUMAN)
TLDEKVDELARFLLLK

SEQ ID NO: 254827 - protein, 17 aa, Homo sapiens
  Native (MAGC1_HUMAN)
TLDEKVDELARFLLLKY

SEQ ID NO: 254828 - protein, 18 aa, Homo sapiens
  Native (MAGC1_HUMAN)
TLDEKVDELARFLLLKYQ

SEQ ID NO: 254829 - protein, 19 aa, Homo sapiens
  Native (MAGC1_HUMAN)
TLDEKVDELARFLLLKYQV

SEQ ID NO: 254830 - protein, 20 aa, Homo sapiens
  Native (MAGC1_HUMAN)
TLDEKVDELARFLLLKYQVK

SEQ ID NO: 254831 - protein, 21 aa, Homo sapiens
  Native (MAGC1_HUMAN)
TLDEKVDELARFLLLKYQVKQ

SEQ ID NO: 254832 - protein, 22 aa, Homo sapiens
  Native (MAGC1_HUMAN)
TLDEKVDELARFLLLKYQVKQP

SEQ ID NO: 254833 - protein, 23 aa, Homo sapiens
  Native (MAGC1_HUMAN)
TLDEKVDELARFLLLKYQVKQPI

SEQ ID NO: 254834 - protein, 24 aa, Homo sapiens
  Native (MAGC1_HUMAN)
TLDEKVDELARFLLLKYQVKQPIT

SEQ ID NO: 254835 - protein, 25 aa, Homo sapiens
  Native (MAGC1_HUMAN)
TLDEKVDELARFLLLKYQVKQPITK

SEQ ID NO: 254836 - protein, 24 aa, Homo sapiens
  Native (MAGC1_HUMAN)
TLDLTSEGCLSDEQGMSQNRLLIL

SEQ ID NO: 254837 - protein, 25 aa, Homo sapiens
  Native (MAGC1_HUMAN)
TLDLTSEGCLSDEQGMSQNRLLILI

SEQ ID NO: 254838 - protein, 20 aa, Homo sapiens
  Native (MAGC1_HUMAN)
TLLESDSLTDSESLIESEPL

SEQ ID NO: 254839 - protein, 22 aa, Homo sapiens
  Native (MAGC1_HUMAN)
TLLESDSLTDSESLIESEPLFT

SEQ ID NO: 254840 - protein, 23 aa, Homo sapiens
  Native (MAGC1_HUMAN)
TLLESDSLTDSESLIESEPLFTY

SEQ ID NO: 254841 - protein, 24 aa, Homo sapiens
  Native (MAGC1_HUMAN)
TLLESDSLTDSESLIESEPLFTYT

SEQ ID NO: 254842 - protein, 25 aa, Homo sapiens
  Native (MAGC1_HUMAN)
TLLESDSLTDSESLIESEPLFTYTL

SEQ ID NO: 254843 - protein, 13 aa, Homo sapiens
  Native (MAGC1_HUMAN)
TLLSIFQSSPERT

SEQ ID NO: 254844 - protein, 14 aa, Homo sapiens
  Native (MAGC1_HUMAN)
TLLSIFQSSPERTQ

SEQ ID NO: 254845 - protein, 15 aa, Homo sapiens
  Native (MAGC1_HUMAN)
TLLSIFQSSPERTQS

SEQ ID NO: 254846 - protein, 16 aa, Homo sapiens
  Native (MAGC1_HUMAN)
TLLSIFQSSPERTQST

SEQ ID NO: 254847 - protein, 17 aa, Homo sapiens
  Native (MAGC1_HUMAN)
TLLSIFQSSPERTQSTF

SEQ ID NO: 254848 - protein, 18 aa, Homo sapiens
  Native (MAGC1_HUMAN)
TLLSIFQSSPERTQSTFE

SEQ ID NO: 254849 - protein, 19 aa, Homo sapiens
  Native (MAGC1_HUMAN)
TLLSIFQSSPERTQSTFEG

SEQ ID NO: 254850 - protein, 20 aa, Homo sapiens
  Native (MAGC1_HUMAN)
TLLSIFQSSPERTQSTFEGF

SEQ ID NO: 254851 - protein, 21 aa, Homo sapiens
  Native (MAGC1_HUMAN)
TLLSIFQSSPERTQSTFEGFA

SEQ ID NO: 254852 - protein, 22 aa, Homo sapiens
  Native (MAGC1_HUMAN)
TLLSIFQSSPERTQSTFEGFAQ

SEQ ID NO: 254853 - protein, 23 aa, Homo sapiens
  Native (MAGC1_HUMAN)
TLLSIFQSSPERTQSTFEGFAQS

SEQ ID NO: 254854 - protein, 24 aa, Homo sapiens
  Native (MAGC1_HUMAN)
TLLSIFQSSPERTQSTFEGFAQSP

SEQ ID NO: 254855 - protein, 25 aa, Homo sapiens
  Native (MAGC1_HUMAN)
TLLSIFQSSPERTQSTFEGFAQSPL

SEQ ID NO: 254856 - protein, 13 aa, Homo sapiens
  Native (MAGC1_HUMAN)
TLLSIFQSSPESA

SEQ ID NO: 254857 - protein, 14 aa, Homo sapiens
  Native (MAGC1_HUMAN)
TLLSIFQSSPESAQ

SEQ ID NO: 254858 - protein, 15 aa, Homo sapiens
  Native (MAGC1_HUMAN)
TLLSIFQSSPESAQS

SEQ ID NO: 254859 - protein, 16 aa, Homo sapiens
  Native (MAGC1_HUMAN)
TLLSIFQSSPESAQST

SEQ ID NO: 254860 - protein, 17 aa, Homo sapiens
  Native (MAGC1_HUMAN)
TLLSIFQSSPESAQSTF

SEQ ID NO: 254861 - protein, 18 aa, Homo sapiens
  Native (MAGC1_HUMAN)
TLLSIFQSSPESAQSTFE

SEQ ID NO: 254862 - protein, 19 aa, Homo sapiens
  Native (MAGC1_HUMAN)
TLLSIFQSSPESAQSTFEG

SEQ ID NO: 254863 - protein, 20 aa, Homo sapiens
  Native (MAGC1_HUMAN)
TLLSIFQSSPESAQSTFEGF

SEQ ID NO: 254864 - protein, 21 aa, Homo sapiens
  Native (MAGC1_HUMAN)
TLLSIFQSSPESAQSTFEGFP

SEQ ID NO: 254865 - protein, 22 aa, Homo sapiens
  Native (MAGC1_HUMAN)
TLLSIFQSSPESAQSTFEGFPQ

SEQ ID NO: 254866 - protein, 23 aa, Homo sapiens
  Native (MAGC1_HUMAN)
TLLSIFQSSPESAQSTFEGFPQS

SEQ ID NO: 254867 - protein, 24 aa, Homo sapiens
  Native (MAGC1_HUMAN)
TLLSIFQSSPESAQSTFEGFPQSP

SEQ ID NO: 254868 - protein, 25 aa, Homo sapiens
  Native (MAGC1_HUMAN)
TLLSIFQSSPESAQSTFEGFPQSPL

SEQ ID NO: 254869 - protein, 14 aa, Homo sapiens
  Native (MAGC1_HUMAN)
TLLSILQSSPESAQ

SEQ ID NO: 254870 - protein, 15 aa, Homo sapiens
  Native (MAGC1_HUMAN)
TLLSILQSSPESAQS

SEQ ID NO: 254871 - protein, 16 aa, Homo sapiens
  Native (MAGC1_HUMAN)
TLLSILQSSPESAQSA

SEQ ID NO: 254872 - protein, 17 aa, Homo sapiens
  Native (MAGC1_HUMAN)
TLLSILQSSPESAQSAF

SEQ ID NO: 254873 - protein, 18 aa, Homo sapiens
  Native (MAGC1_HUMAN)
TLLSILQSSPESAQSAFE

SEQ ID NO: 254874 - protein, 19 aa, Homo sapiens
  Native (MAGC1_HUMAN)
TLLSILQSSPESAQSAFEG

SEQ ID NO: 254875 - protein, 20 aa, Homo sapiens
  Native (MAGC1_HUMAN)
TLLSILQSSPESAQSAFEGF

SEQ ID NO: 254876 - protein, 21 aa, Homo sapiens
  Native (MAGC1_HUMAN)
TLLSILQSSPESAQSAFEGFP

SEQ ID NO: 254877 - protein, 22 aa, Homo sapiens
  Native (MAGC1_HUMAN)
TLLSILQSSPESAQSAFEGFPQ

SEQ ID NO: 254878 - protein, 23 aa, Homo sapiens
  Native (MAGC1_HUMAN)
TLLSILQSSPESAQSAFEGFPQS

SEQ ID NO: 254879 - protein, 24 aa, Homo sapiens
  Native (MAGC1_HUMAN)
TLLSILQSSPESAQSAFEGFPQSP

SEQ ID NO: 254880 - protein, 25 aa, Homo sapiens
  Native (MAGC1_HUMAN)
TLLSILQSSPESAQSAFEGFPQSPL

SEQ ID NO: 254881 - protein, 13 aa, Homo sapiens
  Native (MAGC1_HUMAN)
TLLSLFQSFSERT

SEQ ID NO: 254882 - protein, 14 aa, Homo sapiens
  Native (MAGC1_HUMAN)
TLLSLFQSFSERTQ

SEQ ID NO: 254883 - protein, 15 aa, Homo sapiens
  Native (MAGC1_HUMAN)
TLLSLFQSFSERTQS

SEQ ID NO: 254884 - protein, 16 aa, Homo sapiens
  Native (MAGC1_HUMAN)
TLLSLFQSFSERTQST

SEQ ID NO: 254885 - protein, 17 aa, Homo sapiens
  Native (MAGC1_HUMAN)
TLLSLFQSFSERTQSTF

SEQ ID NO: 254886 - protein, 18 aa, Homo sapiens
  Native (MAGC1_HUMAN)
TLLSLFQSFSERTQSTFE

SEQ ID NO: 254887 - protein, 19 aa, Homo sapiens
  Native (MAGC1_HUMAN)
TLLSLFQSFSERTQSTFEG

SEQ ID NO: 254888 - protein, 20 aa, Homo sapiens
  Native (MAGC1_HUMAN)
TLLSLFQSFSERTQSTFEGF

SEQ ID NO: 254889 - protein, 21 aa, Homo sapiens
  Native (MAGC1_HUMAN)
TLLSLFQSFSERTQSTFEGFA

SEQ ID NO: 254890 - protein, 22 aa, Homo sapiens
  Native (MAGC1_HUMAN)
TLLSLFQSFSERTQSTFEGFAQ

SEQ ID NO: 254891 - protein, 23 aa, Homo sapiens
  Native (MAGC1_HUMAN)
TLLSLFQSFSERTQSTFEGFAQS

SEQ ID NO: 254892 - protein, 24 aa, Homo sapiens
  Native (MAGC1_HUMAN)
TLLSLFQSFSERTQSTFEGFAQSS

SEQ ID NO: 254893 - protein, 25 aa, Homo sapiens
  Native (MAGC1_HUMAN)
TLLSLFQSFSERTQSTFEGFAQSSL

SEQ ID NO: 254894 - protein, 13 aa, Homo sapiens
  Native (MAGC1_HUMAN)
TLLSLFQSSPECT

SEQ ID NO: 254895 - protein, 14 aa, Homo sapiens
  Native (MAGC1_HUMAN)
TLLSLFQSSPECTQ

SEQ ID NO: 254896 - protein, 15 aa, Homo sapiens
  Native (MAGC1_HUMAN)
TLLSLFQSSPECTQS

SEQ ID NO: 254897 - protein, 16 aa, Homo sapiens
  Native (MAGC1_HUMAN)
TLLSLFQSSPECTQST

SEQ ID NO: 254898 - protein, 17 aa, Homo sapiens
  Native (MAGC1_HUMAN)
TLLSLFQSSPECTQSTF

SEQ ID NO: 254899 - protein, 18 aa, Homo sapiens
  Native (MAGC1_HUMAN)
TLLSLFQSSPECTQSTFE

SEQ ID NO: 254900 - protein, 19 aa, Homo sapiens
  Native (MAGC1_HUMAN)
TLLSLFQSSPECTQSTFEG

SEQ ID NO: 254901 - protein, 20 aa, Homo sapiens
  Native (MAGC1_HUMAN)
TLLSLFQSSPECTQSTFEGF

SEQ ID NO: 254902 - protein, 21 aa, Homo sapiens
  Native (MAGC1_HUMAN)
TLLSLFQSSPECTQSTFEGFP

SEQ ID NO: 254903 - protein, 22 aa, Homo sapiens
  Native (MAGC1_HUMAN)
TLLSLFQSSPECTQSTFEGFPQ

SEQ ID NO: 254904 - protein, 23 aa, Homo sapiens
  Native (MAGC1_HUMAN)
TLLSLFQSSPECTQSTFEGFPQS

SEQ ID NO: 254905 - protein, 24 aa, Homo sapiens
  Native (MAGC1_HUMAN)
TLLSLFQSSPECTQSTFEGFPQSP

SEQ ID NO: 254906 - protein, 25 aa, Homo sapiens
  Native (MAGC1_HUMAN)
TLLSLFQSSPECTQSTFEGFPQSPL

SEQ ID NO: 254907 - protein, 13 aa, Homo sapiens
  Native (MAGC1_HUMAN)
TLLSLFQSSPERT

SEQ ID NO: 254908 - protein, 14 aa, Homo sapiens
  Native (MAGC1_HUMAN)
TLLSLFQSSPERTH

SEQ ID NO: 254909 - protein, 15 aa, Homo sapiens
  Native (MAGC1_HUMAN)
TLLSLFQSSPERTHS

SEQ ID NO: 254910 - protein, 16 aa, Homo sapiens
  Native (MAGC1_HUMAN)
TLLSLFQSSPERTHST

SEQ ID NO: 254911 - protein, 17 aa, Homo sapiens
  Native (MAGC1_HUMAN)
TLLSLFQSSPERTHSTF

SEQ ID NO: 254912 - protein, 18 aa, Homo sapiens
  Native (MAGC1_HUMAN)
TLLSLFQSSPERTHSTFE

SEQ ID NO: 254913 - protein, 19 aa, Homo sapiens
  Native (MAGC1_HUMAN)
TLLSLFQSSPERTHSTFEG

SEQ ID NO: 254914 - protein, 20 aa, Homo sapiens
  Native (MAGC1_HUMAN)
TLLSLFQSSPERTHSTFEGF

SEQ ID NO: 254915 - protein, 21 aa, Homo sapiens
  Native (MAGC1_HUMAN)
TLLSLFQSSPERTHSTFEGFP

SEQ ID NO: 254916 - protein, 22 aa, Homo sapiens
  Native (MAGC1_HUMAN)
TLLSLFQSSPERTHSTFEGFPQ

SEQ ID NO: 254917 - protein, 23 aa, Homo sapiens
  Native (MAGC1_HUMAN)
TLLSLFQSSPERTHSTFEGFPQS

SEQ ID NO: 254918 - protein, 24 aa, Homo sapiens
  Native (MAGC1_HUMAN)
TLLSLFQSSPERTHSTFEGFPQSL

SEQ ID NO: 254919 - protein, 25 aa, Homo sapiens
  Native (MAGC1_HUMAN)
TLLSLFQSSPERTHSTFEGFPQSLL

SEQ ID NO: 254920 - protein, 24 aa, Homo sapiens
  Native (MAGC1_HUMAN)
TLLSLFQSSPERTHSTFEGFPQSP

SEQ ID NO: 254921 - protein, 25 aa, Homo sapiens
  Native (MAGC1_HUMAN)
TLLSLFQSSPERTHSTFEGFPQSPL

SEQ ID NO: 254922 - protein, 14 aa, Homo sapiens
  Native (MAGC1_HUMAN)
TLVSIFQSSPESTQ

SEQ ID NO: 254923 - protein, 15 aa, Homo sapiens
  Native (MAGC1_HUMAN)
TLVSIFQSSPESTQS

SEQ ID NO: 254924 - protein, 16 aa, Homo sapiens
  Native (MAGC1_HUMAN)
TLVSIFQSSPESTQSP

SEQ ID NO: 254925 - protein, 17 aa, Homo sapiens
  Native (MAGC1_HUMAN)
TLVSIFQSSPESTQSPF

SEQ ID NO: 254926 - protein, 19 aa, Homo sapiens
  Native (MAGC1_HUMAN)
TLVSIFQSSPESTQSPFEG

SEQ ID NO: 254927 - protein, 20 aa, Homo sapiens
  Native (MAGC1_HUMAN)
TLVSIFQSSPESTQSPFEGF

SEQ ID NO: 254928 - protein, 21 aa, Homo sapiens
  Native (MAGC1_HUMAN)
TLVSIFQSSPESTQSPFEGFP

SEQ ID NO: 254929 - protein, 22 aa, Homo sapiens
  Native (MAGC1_HUMAN)
TLVSIFQSSPESTQSPFEGFPQ

SEQ ID NO: 254930 - protein, 23 aa, Homo sapiens
  Native (MAGC1_HUMAN)
TLVSIFQSSPESTQSPFEGFPQS

SEQ ID NO: 254931 - protein, 24 aa, Homo sapiens
  Native (MAGC1_HUMAN)
TLVSIFQSSPESTQSPFEGFPQSP

SEQ ID NO: 254932 - protein, 25 aa, Homo sapiens
  Native (MAGC1_HUMAN)
TLVSIFQSSPESTQSPFEGFPQSPL

SEQ ID NO: 254933 - protein, 14 aa, Homo sapiens
  Native (MAGC1_HUMAN)
TLVSLFQSSPERTQ

SEQ ID NO: 254934 - protein, 15 aa, Homo sapiens
  Native (MAGC1_HUMAN)
TLVSLFQSSPERTQS

SEQ ID NO: 254935 - protein, 16 aa, Homo sapiens
  Native (MAGC1_HUMAN)
TLVSLFQSSPERTQST

SEQ ID NO: 254936 - protein, 17 aa, Homo sapiens
  Native (MAGC1_HUMAN)
TLVSLFQSSPERTQSTF

SEQ ID NO: 254937 - protein, 18 aa, Homo sapiens
  Native (MAGC1_HUMAN)
TLVSLFQSSPERTQSTFE

SEQ ID NO: 254938 - protein, 19 aa, Homo sapiens
  Native (MAGC1_HUMAN)
TLVSLFQSSPERTQSTFEG

SEQ ID NO: 254939 - protein, 20 aa, Homo sapiens
  Native (MAGC1_HUMAN)
TLVSLFQSSPERTQSTFEGF

SEQ ID NO: 254940 - protein, 21 aa, Homo sapiens
  Native (MAGC1_HUMAN)
TLVSLFQSSPERTQSTFEGFP

SEQ ID NO: 254941 - protein, 22 aa, Homo sapiens
  Native (MAGC1_HUMAN)
TLVSLFQSSPERTQSTFEGFPQ

SEQ ID NO: 254942 - protein, 23 aa, Homo sapiens
  Native (MAGC1_HUMAN)
TLVSLFQSSPERTQSTFEGFPQS

SEQ ID NO: 254943 - protein, 24 aa, Homo sapiens
  Native (MAGC1_HUMAN)
TLVSLFQSSPERTQSTFEGFPQSP

SEQ ID NO: 254944 - protein, 25 aa, Homo sapiens
  Native (MAGC1_HUMAN)
TLVSLFQSSPERTQSTFEGFPQSPL

SEQ ID NO: 254945 - protein, 13 aa, Homo sapiens
  Native (MAGC1_HUMAN)
TLYPLQSPQSRSE

SEQ ID NO: 254946 - protein, 14 aa, Homo sapiens
  Native (MAGC1_HUMAN)
TLYPLQSPQSRSEG

SEQ ID NO: 254947 - protein, 15 aa, Homo sapiens
  Native (MAGC1_HUMAN)
TLYPLQSPQSRSEGE

SEQ ID NO: 254948 - protein, 16 aa, Homo sapiens
  Native (MAGC1_HUMAN)
TLYPLQSPQSRSEGED

SEQ ID NO: 254949 - protein, 17 aa, Homo sapiens
  Native (MAGC1_HUMAN)
TLYPLQSPQSRSEGEDS

SEQ ID NO: 254950 - protein, 19 aa, Homo sapiens
  Native (MAGC1_HUMAN)
TLYPLQSPQSRSEGEDSSD

SEQ ID NO: 254951 - protein, 20 aa, Homo sapiens
  Native (MAGC1_HUMAN)
TLYPLQSPQSRSEGEDSSDP

SEQ ID NO: 254952 - protein, 21 aa, Homo sapiens
  Native (MAGC1_HUMAN)
TLYPLQSPQSRSEGEDSSDPL

SEQ ID NO: 254953 - protein, 22 aa, Homo sapiens
  Native (MAGC1_HUMAN)
TLYPLQSPQSRSEGEDSSDPLQ

SEQ ID NO: 254954 - protein, 23 aa, Homo sapiens
  Native (MAGC1_HUMAN)
TLYPLQSPQSRSEGEDSSDPLQR

SEQ ID NO: 254955 - protein, 24 aa, Homo sapiens
  Native (MAGC1_HUMAN)
TLYPLQSPQSRSEGEDSSDPLQRP

SEQ ID NO: 254956 - protein, 25 aa, Homo sapiens
  Native (MAGC1_HUMAN)
TLYPLQSPQSRSEGEDSSDPLQRPP

SEQ ID NO: 254957 - protein, 13 aa, Homo sapiens
  Native (MAGC1_HUMAN)
TNVISRYTGYFPV

SEQ ID NO: 254958 - protein, 14 aa, Homo sapiens
  Native (MAGC1_HUMAN)
TNVISRYTGYFPVI

SEQ ID NO: 254959 - protein, 15 aa, Homo sapiens
  Native (MAGC1_HUMAN)
TNVISRYTGYFPVIF

SEQ ID NO: 254960 - protein, 16 aa, Homo sapiens
  Native (MAGC1_HUMAN)
TNVISRYTGYFPVIFR

SEQ ID NO: 254961 - protein, 17 aa, Homo sapiens
  Native (MAGC1_HUMAN)
TNVISRYTGYFPVIFRK

SEQ ID NO: 254962 - protein, 18 aa, Homo sapiens
  Native (MAGC1_HUMAN)
TNVISRYTGYFPVIFRKA

SEQ ID NO: 254963 - protein, 19 aa, Homo sapiens
  Native (MAGC1_HUMAN)
TNVISRYTGYFPVIFRKAR

SEQ ID NO: 254964 - protein, 20 aa, Homo sapiens
  Native (MAGC1_HUMAN)
TNVISRYTGYFPVIFRKARE

SEQ ID NO: 254965 - protein, 21 aa, Homo sapiens
  Native (MAGC1_HUMAN)
TNVISRYTGYFPVIFRKAREF

SEQ ID NO: 254966 - protein, 22 aa, Homo sapiens
  Native (MAGC1_HUMAN)
TNVISRYTGYFPVIFRKAREFI

SEQ ID NO: 254967 - protein, 23 aa, Homo sapiens
  Native (MAGC1_HUMAN)
TNVISRYTGYFPVIFRKAREFIE

SEQ ID NO: 254968 - protein, 24 aa, Homo sapiens
  Native (MAGC1_HUMAN)
TNVISRYTGYFPVIFRKAREFIEI

SEQ ID NO: 254969 - protein, 25 aa, Homo sapiens
  Native (MAGC1_HUMAN)
TNVISRYTGYFPVIFRKAREFIEIL

SEQ ID NO: 254970 - protein, 15 aa, Homo sapiens
  Native (MAGC1_HUMAN)
TQSPFEGFPQSPLQI

SEQ ID NO: 254971 - protein, 16 aa, Homo sapiens
  Native (MAGC1_HUMAN)
TQSPFEGFPQSPLQIP

SEQ ID NO: 254972 - protein, 17 aa, Homo sapiens
  Native (MAGC1_HUMAN)
TQSPFEGFPQSPLQIPV

SEQ ID NO: 254973 - protein, 19 aa, Homo sapiens
  Native (MAGC1_HUMAN)
TQSPFEGFPQSPLQIPVSR

SEQ ID NO: 254974 - protein, 20 aa, Homo sapiens
  Native (MAGC1_HUMAN)
TQSPFEGFPQSPLQIPVSRS

SEQ ID NO: 254975 - protein, 21 aa, Homo sapiens
  Native (MAGC1_HUMAN)
TQSPFEGFPQSPLQIPVSRSF

SEQ ID NO: 254976 - protein, 22 aa, Homo sapiens
  Native (MAGC1_HUMAN)
TQSPFEGFPQSPLQIPVSRSFS

SEQ ID NO: 254977 - protein, 23 aa, Homo sapiens
  Native (MAGC1_HUMAN)
TQSPFEGFPQSPLQIPVSRSFSS

SEQ ID NO: 254978 - protein, 24 aa, Homo sapiens
  Native (MAGC1_HUMAN)
TQSPFEGFPQSPLQIPVSRSFSST

SEQ ID NO: 254979 - protein, 25 aa, Homo sapiens
  Native (MAGC1_HUMAN)
TQSPFEGFPQSPLQIPVSRSFSSTL

SEQ ID NO: 254980 - protein, 14 aa, Homo sapiens
  Native (MAGC1_HUMAN)
TQSPFEGFPQSVLQ

SEQ ID NO: 254981 - protein, 15 aa, Homo sapiens
  Native (MAGC1_HUMAN)
TQSPFEGFPQSVLQI

SEQ ID NO: 254982 - protein, 16 aa, Homo sapiens
  Native (MAGC1_HUMAN)
TQSPFEGFPQSVLQIP

SEQ ID NO: 254983 - protein, 17 aa, Homo sapiens
  Native (MAGC1_HUMAN)
TQSPFEGFPQSVLQIPV

SEQ ID NO: 254984 - protein, 18 aa, Homo sapiens
  Native (MAGC1_HUMAN)
TQSPFEGFPQSVLQIPVS

SEQ ID NO: 254985 - protein, 19 aa, Homo sapiens
  Native (MAGC1_HUMAN)
TQSPFEGFPQSVLQIPVSA

SEQ ID NO: 254986 - protein, 20 aa, Homo sapiens
  Native (MAGC1_HUMAN)
TQSPFEGFPQSVLQIPVSAA

SEQ ID NO: 254987 - protein, 21 aa, Homo sapiens
  Native (MAGC1_HUMAN)
TQSPFEGFPQSVLQIPVSAAS

SEQ ID NO: 254988 - protein, 22 aa, Homo sapiens
  Native (MAGC1_HUMAN)
TQSPFEGFPQSVLQIPVSAASS

SEQ ID NO: 254989 - protein, 23 aa, Homo sapiens
  Native (MAGC1_HUMAN)
TQSPFEGFPQSVLQIPVSAASSS

SEQ ID NO: 254990 - protein, 24 aa, Homo sapiens
  Native (MAGC1_HUMAN)
TQSPFEGFPQSVLQIPVSAASSST

SEQ ID NO: 254991 - protein, 25 aa, Homo sapiens
  Native (MAGC1_HUMAN)
TQSPFEGFPQSVLQIPVSAASSSTL

SEQ ID NO: 254992 - protein, 14 aa, Homo sapiens
  Native (MAGC1_HUMAN)
TQSTFEGFAQSPLQ

SEQ ID NO: 254993 - protein, 15 aa, Homo sapiens
  Native (MAGC1_HUMAN)
TQSTFEGFAQSPLQI

SEQ ID NO: 254994 - protein, 16 aa, Homo sapiens
  Native (MAGC1_HUMAN)
TQSTFEGFAQSPLQIP

SEQ ID NO: 254995 - protein, 17 aa, Homo sapiens
  Native (MAGC1_HUMAN)
TQSTFEGFAQSPLQIPV

SEQ ID NO: 254996 - protein, 18 aa, Homo sapiens
  Native (MAGC1_HUMAN)
TQSTFEGFAQSPLQIPVS

SEQ ID NO: 254997 - protein, 19 aa, Homo sapiens
  Native (MAGC1_HUMAN)
TQSTFEGFAQSPLQIPVSP

SEQ ID NO: 254998 - protein, 20 aa, Homo sapiens
  Native (MAGC1_HUMAN)
TQSTFEGFAQSPLQIPVSPS

SEQ ID NO: 254999 - protein, 21 aa, Homo sapiens
  Native (MAGC1_HUMAN)
TQSTFEGFAQSPLQIPVSPSS

SEQ ID NO: 255000 - protein, 22 aa, Homo sapiens
  Native (MAGC1_HUMAN)
TQSTFEGFAQSPLQIPVSPSSS

SEQ ID NO: 255001 - protein, 23 aa, Homo sapiens
  Native (MAGC1_HUMAN)
TQSTFEGFAQSPLQIPVSPSSSS

SEQ ID NO: 255002 - protein, 24 aa, Homo sapiens
  Native (MAGC1_HUMAN)
TQSTFEGFAQSPLQIPVSPSSSST

SEQ ID NO: 255003 - protein, 25 aa, Homo sapiens
  Native (MAGC1_HUMAN)
TQSTFEGFAQSPLQIPVSPSSSSTL

SEQ ID NO: 255004 - protein, 14 aa, Homo sapiens
  Native (MAGC1_HUMAN)
TQSTFEGFAQSSLQ

SEQ ID NO: 255005 - protein, 15 aa, Homo sapiens
  Native (MAGC1_HUMAN)
TQSTFEGFAQSSLQI

SEQ ID NO: 255006 - protein, 16 aa, Homo sapiens
  Native (MAGC1_HUMAN)
TQSTFEGFAQSSLQIP

SEQ ID NO: 255007 - protein, 17 aa, Homo sapiens
  Native (MAGC1_HUMAN)
TQSTFEGFAQSSLQIPV

SEQ ID NO: 255008 - protein, 18 aa, Homo sapiens
  Native (MAGC1_HUMAN)
TQSTFEGFAQSSLQIPVS

SEQ ID NO: 255009 - protein, 19 aa, Homo sapiens
  Native (MAGC1_HUMAN)
TQSTFEGFAQSSLQIPVSP

SEQ ID NO: 255010 - protein, 20 aa, Homo sapiens
  Native (MAGC1_HUMAN)
TQSTFEGFAQSSLQIPVSPS

SEQ ID NO: 255011 - protein, 21 aa, Homo sapiens
  Native (MAGC1_HUMAN)
TQSTFEGFAQSSLQIPVSPSF

SEQ ID NO: 255012 - protein, 22 aa, Homo sapiens
  Native (MAGC1_HUMAN)
TQSTFEGFAQSSLQIPVSPSFS

SEQ ID NO: 255013 - protein, 23 aa, Homo sapiens
  Native (MAGC1_HUMAN)
TQSTFEGFAQSSLQIPVSPSFSS

SEQ ID NO: 255014 - protein, 24 aa, Homo sapiens
  Native (MAGC1_HUMAN)
TQSTFEGFAQSSLQIPVSPSFSST

SEQ ID NO: 255015 - protein, 25 aa, Homo sapiens
  Native (MAGC1_HUMAN)
TQSTFEGFAQSSLQIPVSPSFSSTL

SEQ ID NO: 255016 - protein, 15 aa, Homo sapiens
  Native (MAGC1_HUMAN)
TQSTFEGFPQSPLQI

SEQ ID NO: 255017 - protein, 16 aa, Homo sapiens
  Native (MAGC1_HUMAN)
TQSTFEGFPQSPLQIP

SEQ ID NO: 255018 - protein, 17 aa, Homo sapiens
  Native (MAGC1_HUMAN)
TQSTFEGFPQSPLQIPQ

SEQ ID NO: 255019 - protein, 19 aa, Homo sapiens
  Native (MAGC1_HUMAN)
TQSTFEGFPQSPLQIPQSP

SEQ ID NO: 255020 - protein, 20 aa, Homo sapiens
  Native (MAGC1_HUMAN)
TQSTFEGFPQSPLQIPQSPP

SEQ ID NO: 255021 - protein, 21 aa, Homo sapiens
  Native (MAGC1_HUMAN)
TQSTFEGFPQSPLQIPQSPPE

SEQ ID NO: 255022 - protein, 22 aa, Homo sapiens
  Native (MAGC1_HUMAN)
TQSTFEGFPQSPLQIPQSPPEG

SEQ ID NO: 255023 - protein, 23 aa, Homo sapiens
  Native (MAGC1_HUMAN)
TQSTFEGFPQSPLQIPQSPPEGE

SEQ ID NO: 255024 - protein, 24 aa, Homo sapiens
  Native (MAGC1_HUMAN)
TQSTFEGFPQSPLQIPQSPPEGEN

SEQ ID NO: 255025 - protein, 25 aa, Homo sapiens
  Native (MAGC1_HUMAN)
TQSTFEGFPQSPLQIPQSPPEGENT

SEQ ID NO: 255026 - protein, 17 aa, Homo sapiens
  Native (MAGC1_HUMAN)
TQSTFEGFPQSPLQIPV

SEQ ID NO: 255027 - protein, 19 aa, Homo sapiens
  Native (MAGC1_HUMAN)
TQSTFEGFPQSPLQIPVSS

SEQ ID NO: 255028 - protein, 20 aa, Homo sapiens
  Native (MAGC1_HUMAN)
TQSTFEGFPQSPLQIPVSSS

SEQ ID NO: 255029 - protein, 21 aa, Homo sapiens
  Native (MAGC1_HUMAN)
TQSTFEGFPQSPLQIPVSSSS

SEQ ID NO: 255030 - protein, 22 aa, Homo sapiens
  Native (MAGC1_HUMAN)
TQSTFEGFPQSPLQIPVSSSSS

SEQ ID NO: 255031 - protein, 23 aa, Homo sapiens
  Native (MAGC1_HUMAN)
TQSTFEGFPQSPLQIPVSSSSSS

SEQ ID NO: 255032 - protein, 24 aa, Homo sapiens
  Native (MAGC1_HUMAN)
TQSTFEGFPQSPLQIPVSSSSSST

SEQ ID NO: 255033 - protein, 25 aa, Homo sapiens
  Native (MAGC1_HUMAN)
TQSTFEGFPQSPLQIPVSSSSSSTL

SEQ ID NO: 255034 - protein, 20 aa, Homo sapiens
  Native (MAGC1_HUMAN)
TSEGCLSDEQGMSQNRLLIL

SEQ ID NO: 255035 - protein, 21 aa, Homo sapiens
  Native (MAGC1_HUMAN)
TSEGCLSDEQGMSQNRLLILI

SEQ ID NO: 255036 - protein, 22 aa, Homo sapiens
  Native (MAGC1_HUMAN)
TSEGCLSDEQGMSQNRLLILIL

SEQ ID NO: 255037 - protein, 23 aa, Homo sapiens
  Native (MAGC1_HUMAN)
TSEGCLSDEQGMSQNRLLILILS

SEQ ID NO: 255038 - protein, 24 aa, Homo sapiens
  Native (MAGC1_HUMAN)
TSEGCLSDEQGMSQNRLLILILSI

SEQ ID NO: 255039 - protein, 25 aa, Homo sapiens
  Native (MAGC1_HUMAN)
TSEGCLSDEQGMSQNRLLILILSII

SEQ ID NO: 255040 - protein, 15 aa, Homo sapiens
  Native (MAGC1_HUMAN)
TSLSPFSEESSSPVD

SEQ ID NO: 255041 - protein, 20 aa, Homo sapiens
  Native (MAGC1_HUMAN)
TSLSPFSEESSSPVDEYTSS

SEQ ID NO: 255042 - protein, 13 aa, Homo sapiens
  Native (MAGC1_HUMAN)
TSSFSSTLLSIFQ

SEQ ID NO: 255043 - protein, 14 aa, Homo sapiens
  Native (MAGC1_HUMAN)
TSSFSSTLLSIFQS

SEQ ID NO: 255044 - protein, 15 aa, Homo sapiens
  Native (MAGC1_HUMAN)
TSSFSSTLLSIFQSS

SEQ ID NO: 255045 - protein, 16 aa, Homo sapiens
  Native (MAGC1_HUMAN)
TSSFSSTLLSIFQSSP

SEQ ID NO: 255046 - protein, 17 aa, Homo sapiens
  Native (MAGC1_HUMAN)
TSSFSSTLLSIFQSSPE

SEQ ID NO: 255047 - protein, 18 aa, Homo sapiens
  Native (MAGC1_HUMAN)
TSSFSSTLLSIFQSSPES

SEQ ID NO: 255048 - protein, 19 aa, Homo sapiens
  Native (MAGC1_HUMAN)
TSSFSSTLLSIFQSSPESA

SEQ ID NO: 255049 - protein, 20 aa, Homo sapiens
  Native (MAGC1_HUMAN)
TSSFSSTLLSIFQSSPESAQ

SEQ ID NO: 255050 - protein, 21 aa, Homo sapiens
  Native (MAGC1_HUMAN)
TSSFSSTLLSIFQSSPESAQS

SEQ ID NO: 255051 - protein, 22 aa, Homo sapiens
  Native (MAGC1_HUMAN)
TSSFSSTLLSIFQSSPESAQST

SEQ ID NO: 255052 - protein, 23 aa, Homo sapiens
  Native (MAGC1_HUMAN)
TSSFSSTLLSIFQSSPESAQSTF

SEQ ID NO: 255053 - protein, 24 aa, Homo sapiens
  Native (MAGC1_HUMAN)
TSSFSSTLLSIFQSSPESAQSTFE

SEQ ID NO: 255054 - protein, 25 aa, Homo sapiens
  Native (MAGC1_HUMAN)
TSSFSSTLLSIFQSSPESAQSTFEG

SEQ ID NO: 255055 - protein, 13 aa, Homo sapiens
  Native (MAGC1_HUMAN)
TSSFSSTLLSILQ

SEQ ID NO: 255056 - protein, 14 aa, Homo sapiens
  Native (MAGC1_HUMAN)
TSSFSSTLLSILQS

SEQ ID NO: 255057 - protein, 16 aa, Homo sapiens
  Native (MAGC1_HUMAN)
TSSFSSTLLSILQSSP

SEQ ID NO: 255058 - protein, 17 aa, Homo sapiens
  Native (MAGC1_HUMAN)
TSSFSSTLLSILQSSPE

SEQ ID NO: 255059 - protein, 18 aa, Homo sapiens
  Native (MAGC1_HUMAN)
TSSFSSTLLSILQSSPES

SEQ ID NO: 255060 - protein, 19 aa, Homo sapiens
  Native (MAGC1_HUMAN)
TSSFSSTLLSILQSSPESA

SEQ ID NO: 255061 - protein, 20 aa, Homo sapiens
  Native (MAGC1_HUMAN)
TSSFSSTLLSILQSSPESAQ

SEQ ID NO: 255062 - protein, 21 aa, Homo sapiens
  Native (MAGC1_HUMAN)
TSSFSSTLLSILQSSPESAQS

SEQ ID NO: 255063 - protein, 22 aa, Homo sapiens
  Native (MAGC1_HUMAN)
TSSFSSTLLSILQSSPESAQSA

SEQ ID NO: 255064 - protein, 23 aa, Homo sapiens
  Native (MAGC1_HUMAN)
TSSFSSTLLSILQSSPESAQSAF

SEQ ID NO: 255065 - protein, 24 aa, Homo sapiens
  Native (MAGC1_HUMAN)
TSSFSSTLLSILQSSPESAQSAFE

SEQ ID NO: 255066 - protein, 25 aa, Homo sapiens
  Native (MAGC1_HUMAN)
TSSFSSTLLSILQSSPESAQSAFEG

SEQ ID NO: 255067 - protein, 13 aa, Homo sapiens
  Native (MAGC1_HUMAN)
TSSSLSQSSPVSS

SEQ ID NO: 255068 - protein, 14 aa, Homo sapiens
  Native (MAGC1_HUMAN)
TSSSLSQSSPVSSF

SEQ ID NO: 255069 - protein, 15 aa, Homo sapiens
  Native (MAGC1_HUMAN)
TSSSLSQSSPVSSFP

SEQ ID NO: 255070 - protein, 16 aa, Homo sapiens
  Native (MAGC1_HUMAN)
TSSSLSQSSPVSSFPS

SEQ ID NO: 255071 - protein, 17 aa, Homo sapiens
  Native (MAGC1_HUMAN)
TSSSLSQSSPVSSFPSS

SEQ ID NO: 255072 - protein, 18 aa, Homo sapiens
  Native (MAGC1_HUMAN)
TSSSLSQSSPVSSFPSST

SEQ ID NO: 255073 - protein, 19 aa, Homo sapiens
  Native (MAGC1_HUMAN)
TSSSLSQSSPVSSFPSSTS

SEQ ID NO: 255074 - protein, 20 aa, Homo sapiens
  Native (MAGC1_HUMAN)
TSSSLSQSSPVSSFPSSTSS

SEQ ID NO: 255075 - protein, 21 aa, Homo sapiens
  Native (MAGC1_HUMAN)
TSSSLSQSSPVSSFPSSTSSS

SEQ ID NO: 255076 - protein, 22 aa, Homo sapiens
  Native (MAGC1_HUMAN)
TSSSLSQSSPVSSFPSSTSSSL

SEQ ID NO: 255077 - protein, 23 aa, Homo sapiens
  Native (MAGC1_HUMAN)
TSSSLSQSSPVSSFPSSTSSSLS

SEQ ID NO: 255078 - protein, 24 aa, Homo sapiens
  Native (MAGC1_HUMAN)
TSSSLSQSSPVSSFPSSTSSSLSK

SEQ ID NO: 255079 - protein, 25 aa, Homo sapiens
  Native (MAGC1_HUMAN)
TSSSLSQSSPVSSFPSSTSSSLSKS

SEQ ID NO: 255080 - protein, 14 aa, Homo sapiens
  Native (MAGC1_HUMAN)
TTDDSTATESASSS

SEQ ID NO: 255081 - protein, 15 aa, Homo sapiens
  Native (MAGC1_HUMAN)
TTDDSTATESASSSV

SEQ ID NO: 255082 - protein, 16 aa, Homo sapiens
  Native (MAGC1_HUMAN)
TTDDSTATESASSSVM

SEQ ID NO: 255083 - protein, 17 aa, Homo sapiens
  Native (MAGC1_HUMAN)
TTDDSTATESASSSVMS

SEQ ID NO: 255084 - protein, 18 aa, Homo sapiens
  Native (MAGC1_HUMAN)
TTDDSTATESASSSVMSP

SEQ ID NO: 255085 - protein, 19 aa, Homo sapiens
  Native (MAGC1_HUMAN)
TTDDSTATESASSSVMSPS

SEQ ID NO: 255086 - protein, 20 aa, Homo sapiens
  Native (MAGC1_HUMAN)
TTDDSTATESASSSVMSPSF

SEQ ID NO: 255087 - protein, 21 aa, Homo sapiens
  Native (MAGC1_HUMAN)
TTDDSTATESASSSVMSPSFS

SEQ ID NO: 255088 - protein, 22 aa, Homo sapiens
  Native (MAGC1_HUMAN)
TTDDSTATESASSSVMSPSFSS

SEQ ID NO: 255089 - protein, 23 aa, Homo sapiens
  Native (MAGC1_HUMAN)
TTDDSTATESASSSVMSPSFSSE

SEQ ID NO: 255090 - protein, 14 aa, Homo sapiens
  Native (MAGC1_HUMAN)
TYASEEVIWDVLSG

SEQ ID NO: 255091 - protein, 15 aa, Homo sapiens
  Native (MAGC1_HUMAN)
TYASEEVIWDVLSGI

SEQ ID NO: 255092 - protein, 16 aa, Homo sapiens
  Native (MAGC1_HUMAN)
TYASEEVIWDVLSGIG

SEQ ID NO: 255093 - protein, 17 aa, Homo sapiens
  Native (MAGC1_HUMAN)
TYASEEVIWDVLSGIGV

SEQ ID NO: 255094 - protein, 18 aa, Homo sapiens
  Native (MAGC1_HUMAN)
TYASEEVIWDVLSGIGVR

SEQ ID NO: 255095 - protein, 19 aa, Homo sapiens
  Native (MAGC1_HUMAN)
TYASEEVIWDVLSGIGVRA

SEQ ID NO: 255096 - protein, 20 aa, Homo sapiens
  Native (MAGC1_HUMAN)
TYASEEVIWDVLSGIGVRAG

SEQ ID NO: 255097 - protein, 21 aa, Homo sapiens
  Native (MAGC1_HUMAN)
TYASEEVIWDVLSGIGVRAGR

SEQ ID NO: 255098 - protein, 22 aa, Homo sapiens
  Native (MAGC1_HUMAN)
TYASEEVIWDVLSGIGVRAGRE

SEQ ID NO: 255099 - protein, 23 aa, Homo sapiens
  Native (MAGC1_HUMAN)
TYASEEVIWDVLSGIGVRAGREH

SEQ ID NO: 255100 - protein, 24 aa, Homo sapiens
  Native (MAGC1_HUMAN)
TYASEEVIWDVLSGIGVRAGREHF

SEQ ID NO: 255101 - protein, 25 aa, Homo sapiens
  Native (MAGC1_HUMAN)
TYASEEVIWDVLSGIGVRAGREHFA

SEQ ID NO: 255102 - protein, 15 aa, Homo sapiens
  Native (MAGC1_HUMAN)
TYTLDEKVDELARFL

SEQ ID NO: 255103 - protein, 16 aa, Homo sapiens
  Native (MAGC1_HUMAN)
TYTLDEKVDELARFLL

SEQ ID NO: 255104 - protein, 17 aa, Homo sapiens
  Native (MAGC1_HUMAN)
TYTLDEKVDELARFLLL

SEQ ID NO: 255105 - protein, 18 aa, Homo sapiens
  Native (MAGC1_HUMAN)
TYTLDEKVDELARFLLLK

SEQ ID NO: 255106 - protein, 19 aa, Homo sapiens
  Native (MAGC1_HUMAN)
TYTLDEKVDELARFLLLKY

SEQ ID NO: 255107 - protein, 20 aa, Homo sapiens
  Native (MAGC1_HUMAN)
TYTLDEKVDELARFLLLKYQ

SEQ ID NO: 255108 - protein, 21 aa, Homo sapiens
  Native (MAGC1_HUMAN)
TYTLDEKVDELARFLLLKYQV

SEQ ID NO: 255109 - protein, 22 aa, Homo sapiens
  Native (MAGC1_HUMAN)
TYTLDEKVDELARFLLLKYQVK

SEQ ID NO: 255110 - protein, 23 aa, Homo sapiens
  Native (MAGC1_HUMAN)
TYTLDEKVDELARFLLLKYQVKQ

SEQ ID NO: 255111 - protein, 24 aa, Homo sapiens
  Native (MAGC1_HUMAN)
TYTLDEKVDELARFLLLKYQVKQP

SEQ ID NO: 255112 - protein, 25 aa, Homo sapiens
  Native (MAGC1_HUMAN)
TYTLDEKVDELARFLLLKYQVKQPI

SEQ ID NO: 255113 - protein, 13 aa, Homo sapiens
  Native (MAGC1_HUMAN)
VDELARFLLLKYQ

SEQ ID NO: 255114 - protein, 14 aa, Homo sapiens
  Native (MAGC1_HUMAN)
VDELARFLLLKYQV

SEQ ID NO: 255115 - protein, 15 aa, Homo sapiens
  Native (MAGC1_HUMAN)
VDELARFLLLKYQVK

SEQ ID NO: 255116 - protein, 16 aa, Homo sapiens
  Native (MAGC1_HUMAN)
VDELARFLLLKYQVKQ

SEQ ID NO: 255117 - protein, 17 aa, Homo sapiens
  Native (MAGC1_HUMAN)
VDELARFLLLKYQVKQP

SEQ ID NO: 255118 - protein, 18 aa, Homo sapiens
  Native (MAGC1_HUMAN)
VDELARFLLLKYQVKQPI

SEQ ID NO: 255119 - protein, 19 aa, Homo sapiens
  Native (MAGC1_HUMAN)
VDELARFLLLKYQVKQPIT

SEQ ID NO: 255120 - protein, 20 aa, Homo sapiens
  Native (MAGC1_HUMAN)
VDELARFLLLKYQVKQPITK

SEQ ID NO: 255121 - protein, 21 aa, Homo sapiens
  Native (MAGC1_HUMAN)
VDELARFLLLKYQVKQPITKA

SEQ ID NO: 255122 - protein, 22 aa, Homo sapiens
  Native (MAGC1_HUMAN)
VDELARFLLLKYQVKQPITKAE

SEQ ID NO: 255123 - protein, 23 aa, Homo sapiens
  Native (MAGC1_HUMAN)
VDELARFLLLKYQVKQPITKAEM

SEQ ID NO: 255124 - protein, 24 aa, Homo sapiens
  Native (MAGC1_HUMAN)
VDELARFLLLKYQVKQPITKAEML

SEQ ID NO: 255125 - protein, 25 aa, Homo sapiens
  Native (MAGC1_HUMAN)
VDELARFLLLKYQVKQPITKAEMLT

SEQ ID NO: 255126 - protein, 15 aa, Homo sapiens
  Native (MAGC1_HUMAN)
VDEYTSSSDTLLESD

SEQ ID NO: 255127 - protein, 16 aa, Homo sapiens
  Native (MAGC1_HUMAN)
VDEYTSSSDTLLESDS

SEQ ID NO: 255128 - protein, 17 aa, Homo sapiens
  Native (MAGC1_HUMAN)
VDEYTSSSDTLLESDSL

SEQ ID NO: 255129 - protein, 19 aa, Homo sapiens
  Native (MAGC1_HUMAN)
VDEYTSSSDTLLESDSLTD

SEQ ID NO: 255130 - protein, 20 aa, Homo sapiens
  Native (MAGC1_HUMAN)
VDEYTSSSDTLLESDSLTDS

SEQ ID NO: 255131 - protein, 21 aa, Homo sapiens
  Native (MAGC1_HUMAN)
VDEYTSSSDTLLESDSLTDSE

SEQ ID NO: 255132 - protein, 22 aa, Homo sapiens
  Native (MAGC1_HUMAN)
VDEYTSSSDTLLESDSLTDSES

SEQ ID NO: 255133 - protein, 23 aa, Homo sapiens
  Native (MAGC1_HUMAN)
VDEYTSSSDTLLESDSLTDSESL

SEQ ID NO: 255134 - protein, 24 aa, Homo sapiens
  Native (MAGC1_HUMAN)
VDEYTSSSDTLLESDSLTDSESLI

SEQ ID NO: 255135 - protein, 25 aa, Homo sapiens
  Native (MAGC1_HUMAN)
VDEYTSSSDTLLESDSLTDSESLIE

SEQ ID NO: 255136 - protein, 15 aa, Homo sapiens
  Native (MAGC1_HUMAN)
VDPDDSYVFVNTLDL

SEQ ID NO: 255137 - protein, 16 aa, Homo sapiens
  Native (MAGC1_HUMAN)
VDPDDSYVFVNTLDLT

SEQ ID NO: 255138 - protein, 17 aa, Homo sapiens
  Native (MAGC1_HUMAN)
VDPDDSYVFVNTLDLTS

SEQ ID NO: 255139 - protein, 18 aa, Homo sapiens
  Native (MAGC1_HUMAN)
VDPDDSYVFVNTLDLTSE

SEQ ID NO: 255140 - protein, 19 aa, Homo sapiens
  Native (MAGC1_HUMAN)
VDPDDSYVFVNTLDLTSEG

SEQ ID NO: 255141 - protein, 20 aa, Homo sapiens
  Native (MAGC1_HUMAN)
VDPDDSYVFVNTLDLTSEGC

SEQ ID NO: 255142 - protein, 21 aa, Homo sapiens
  Native (MAGC1_HUMAN)
VDPDDSYVFVNTLDLTSEGCL

SEQ ID NO: 255143 - protein, 22 aa, Homo sapiens
  Native (MAGC1_HUMAN)
VDPDDSYVFVNTLDLTSEGCLS

SEQ ID NO: 255144 - protein, 23 aa, Homo sapiens
  Native (MAGC1_HUMAN)
VDPDDSYVFVNTLDLTSEGCLSD

SEQ ID NO: 255145 - protein, 24 aa, Homo sapiens
  Native (MAGC1_HUMAN)
VDPDDSYVFVNTLDLTSEGCLSDE

SEQ ID NO: 255146 - protein, 25 aa, Homo sapiens
  Native (MAGC1_HUMAN)
VDPDDSYVFVNTLDLTSEGCLSDEQ

SEQ ID NO: 255147 - protein, 16 aa, Homo sapiens
  Native (MAGC1_HUMAN)
VEERAQAIIDTTDDST

SEQ ID NO: 255148 - protein, 19 aa, Homo sapiens
  Native (MAGC1_HUMAN)
VEERAQAIIDTTDDSTATE

SEQ ID NO: 255149 - protein, 20 aa, Homo sapiens
  Native (MAGC1_HUMAN)
VEERAQAIIDTTDDSTATES

SEQ ID NO: 255150 - protein, 25 aa, Homo sapiens
  Native (MAGC1_HUMAN)
VEERAQAIIDTTDDSTATESASSSV

SEQ ID NO: 255151 - protein, 13 aa, Homo sapiens
  Native (MAGC1_HUMAN)
VEFLAMLKNTVPI

SEQ ID NO: 255152 - protein, 14 aa, Homo sapiens
  Native (MAGC1_HUMAN)
VEFLAMLKNTVPIT

SEQ ID NO: 255153 - protein, 16 aa, Homo sapiens
  Native (MAGC1_HUMAN)
VEFLAMLKNTVPITFP

SEQ ID NO: 255154 - protein, 17 aa, Homo sapiens
  Native (MAGC1_HUMAN)
VEFLAMLKNTVPITFPS

SEQ ID NO: 255155 - protein, 18 aa, Homo sapiens
  Native (MAGC1_HUMAN)
VEFLAMLKNTVPITFPSS

SEQ ID NO: 255156 - protein, 19 aa, Homo sapiens
  Native (MAGC1_HUMAN)
VEFLAMLKNTVPITFPSSY

SEQ ID NO: 255157 - protein, 20 aa, Homo sapiens
  Native (MAGC1_HUMAN)
VEFLAMLKNTVPITFPSSYK

SEQ ID NO: 255158 - protein, 21 aa, Homo sapiens
  Native (MAGC1_HUMAN)
VEFLAMLKNTVPITFPSSYKD

SEQ ID NO: 255159 - protein, 22 aa, Homo sapiens
  Native (MAGC1_HUMAN)
VEFLAMLKNTVPITFPSSYKDA

SEQ ID NO: 255160 - protein, 23 aa, Homo sapiens
  Native (MAGC1_HUMAN)
VEFLAMLKNTVPITFPSSYKDAL

SEQ ID NO: 255161 - protein, 24 aa, Homo sapiens
  Native (MAGC1_HUMAN)
VEFLAMLKNTVPITFPSSYKDALK

SEQ ID NO: 255162 - protein, 25 aa, Homo sapiens
  Native (MAGC1_HUMAN)
VEFLAMLKNTVPITFPSSYKDALKD

SEQ ID NO: 255163 - protein, 15 aa, Homo sapiens
  Native (MAGC1_HUMAN)
VFVNTLDLTSEGCLS

SEQ ID NO: 255164 - protein, 16 aa, Homo sapiens
  Native (MAGC1_HUMAN)
VFVNTLDLTSEGCLSD

SEQ ID NO: 255165 - protein, 17 aa, Homo sapiens
  Native (MAGC1_HUMAN)
VFVNTLDLTSEGCLSDE

SEQ ID NO: 255166 - protein, 20 aa, Homo sapiens
  Native (MAGC1_HUMAN)
VFVNTLDLTSEGCLSDEQGM

SEQ ID NO: 255167 - protein, 13 aa, Homo sapiens
  Native (MAGC1_HUMAN)
VIFRKAREFIEIL

SEQ ID NO: 255168 - protein, 14 aa, Homo sapiens
  Native (MAGC1_HUMAN)
VIFRKAREFIEILF

SEQ ID NO: 255169 - protein, 15 aa, Homo sapiens
  Native (MAGC1_HUMAN)
VIFRKAREFIEILFG

SEQ ID NO: 255170 - protein, 16 aa, Homo sapiens
  Native (MAGC1_HUMAN)
VIFRKAREFIEILFGI

SEQ ID NO: 255171 - protein, 17 aa, Homo sapiens
  Native (MAGC1_HUMAN)
VIFRKAREFIEILFGIS

SEQ ID NO: 255172 - protein, 18 aa, Homo sapiens
  Native (MAGC1_HUMAN)
VIFRKAREFIEILFGISL

SEQ ID NO: 255173 - protein, 19 aa, Homo sapiens
  Native (MAGC1_HUMAN)
VIFRKAREFIEILFGISLR

SEQ ID NO: 255174 - protein, 20 aa, Homo sapiens
  Native (MAGC1_HUMAN)
VIFRKAREFIEILFGISLRE

SEQ ID NO: 255175 - protein, 21 aa, Homo sapiens
  Native (MAGC1_HUMAN)
VIFRKAREFIEILFGISLREV

SEQ ID NO: 255176 - protein, 22 aa, Homo sapiens
  Native (MAGC1_HUMAN)
VIFRKAREFIEILFGISLREVD

SEQ ID NO: 255177 - protein, 23 aa, Homo sapiens
  Native (MAGC1_HUMAN)
VIFRKAREFIEILFGISLREVDP

SEQ ID NO: 255178 - protein, 24 aa, Homo sapiens
  Native (MAGC1_HUMAN)
VIFRKAREFIEILFGISLREVDPD

SEQ ID NO: 255179 - protein, 25 aa, Homo sapiens
  Native (MAGC1_HUMAN)
VIFRKAREFIEILFGISLREVDPDD

SEQ ID NO: 255180 - protein, 13 aa, Homo sapiens
  Native (MAGC1_HUMAN)
VIKRKVVEFLAML

SEQ ID NO: 255181 - protein, 14 aa, Homo sapiens
  Native (MAGC1_HUMAN)
VIKRKVVEFLAMLK

SEQ ID NO: 255182 - protein, 15 aa, Homo sapiens
  Native (MAGC1_HUMAN)
VIKRKVVEFLAMLKN

SEQ ID NO: 255183 - protein, 16 aa, Homo sapiens
  Native (MAGC1_HUMAN)
VIKRKVVEFLAMLKNT

SEQ ID NO: 255184 - protein, 17 aa, Homo sapiens
  Native (MAGC1_HUMAN)
VIKRKVVEFLAMLKNTV

SEQ ID NO: 255185 - protein, 18 aa, Homo sapiens
  Native (MAGC1_HUMAN)
VIKRKVVEFLAMLKNTVP

SEQ ID NO: 255186 - protein, 19 aa, Homo sapiens
  Native (MAGC1_HUMAN)
VIKRKVVEFLAMLKNTVPI

SEQ ID NO: 255187 - protein, 20 aa, Homo sapiens
  Native (MAGC1_HUMAN)
VIKRKVVEFLAMLKNTVPIT

SEQ ID NO: 255188 - protein, 21 aa, Homo sapiens
  Native (MAGC1_HUMAN)
VIKRKVVEFLAMLKNTVPITF

SEQ ID NO: 255189 - protein, 22 aa, Homo sapiens
  Native (MAGC1_HUMAN)
VIKRKVVEFLAMLKNTVPITFP

SEQ ID NO: 255190 - protein, 23 aa, Homo sapiens
  Native (MAGC1_HUMAN)
VIKRKVVEFLAMLKNTVPITFPS

SEQ ID NO: 255191 - protein, 24 aa, Homo sapiens
  Native (MAGC1_HUMAN)
VIKRKVVEFLAMLKNTVPITFPSS

SEQ ID NO: 255192 - protein, 25 aa, Homo sapiens
  Native (MAGC1_HUMAN)
VIKRKVVEFLAMLKNTVPITFPSSY

SEQ ID NO: 255193 - protein, 13 aa, Homo sapiens
  Native (MAGC1_HUMAN)
VISFSSSTSLSPF

SEQ ID NO: 255194 - protein, 14 aa, Homo sapiens
  Native (MAGC1_HUMAN)
VISFSSSTSLSPFS

SEQ ID NO: 255195 - protein, 15 aa, Homo sapiens
  Native (MAGC1_HUMAN)
VISFSSSTSLSPFSE

SEQ ID NO: 255196 - protein, 16 aa, Homo sapiens
  Native (MAGC1_HUMAN)
VISFSSSTSLSPFSEE

SEQ ID NO: 255197 - protein, 17 aa, Homo sapiens
  Native (MAGC1_HUMAN)
VISFSSSTSLSPFSEES

SEQ ID NO: 255198 - protein, 18 aa, Homo sapiens
  Native (MAGC1_HUMAN)
VISFSSSTSLSPFSEESS

SEQ ID NO: 255199 - protein, 19 aa, Homo sapiens
  Native (MAGC1_HUMAN)
VISFSSSTSLSPFSEESSS

SEQ ID NO: 255200 - protein, 20 aa, Homo sapiens
  Native (MAGC1_HUMAN)
VISFSSSTSLSPFSEESSSP

SEQ ID NO: 255201 - protein, 21 aa, Homo sapiens
  Native (MAGC1_HUMAN)
VISFSSSTSLSPFSEESSSPV

SEQ ID NO: 255202 - protein, 22 aa, Homo sapiens
  Native (MAGC1_HUMAN)
VISFSSSTSLSPFSEESSSPVD

SEQ ID NO: 255203 - protein, 23 aa, Homo sapiens
  Native (MAGC1_HUMAN)
VISFSSSTSLSPFSEESSSPVDE

SEQ ID NO: 255204 - protein, 24 aa, Homo sapiens
  Native (MAGC1_HUMAN)
VISFSSSTSLSPFSEESSSPVDEY

SEQ ID NO: 255205 - protein, 25 aa, Homo sapiens
  Native (MAGC1_HUMAN)
VISFSSSTSLSPFSEESSSPVDEYT

SEQ ID NO: 255206 - protein, 13 aa, Homo sapiens
  Native (MAGC1_HUMAN)
VISRYTGYFPVIF

SEQ ID NO: 255207 - protein, 14 aa, Homo sapiens
  Native (MAGC1_HUMAN)
VISRYTGYFPVIFR

SEQ ID NO: 255208 - protein, 15 aa, Homo sapiens
  Native (MAGC1_HUMAN)
VISRYTGYFPVIFRK

SEQ ID NO: 255209 - protein, 16 aa, Homo sapiens
  Native (MAGC1_HUMAN)
VISRYTGYFPVIFRKA

SEQ ID NO: 255210 - protein, 17 aa, Homo sapiens
  Native (MAGC1_HUMAN)
VISRYTGYFPVIFRKAR

SEQ ID NO: 255211 - protein, 18 aa, Homo sapiens
  Native (MAGC1_HUMAN)
VISRYTGYFPVIFRKARE

SEQ ID NO: 255212 - protein, 19 aa, Homo sapiens
  Native (MAGC1_HUMAN)
VISRYTGYFPVIFRKAREF

SEQ ID NO: 255213 - protein, 20 aa, Homo sapiens
  Native (MAGC1_HUMAN)
VISRYTGYFPVIFRKAREFI

SEQ ID NO: 255214 - protein, 21 aa, Homo sapiens
  Native (MAGC1_HUMAN)
VISRYTGYFPVIFRKAREFIE

SEQ ID NO: 255215 - protein, 22 aa, Homo sapiens
  Native (MAGC1_HUMAN)
VISRYTGYFPVIFRKAREFIEI

SEQ ID NO: 255216 - protein, 23 aa, Homo sapiens
  Native (MAGC1_HUMAN)
VISRYTGYFPVIFRKAREFIEIL

SEQ ID NO: 255217 - protein, 24 aa, Homo sapiens
  Native (MAGC1_HUMAN)
VISRYTGYFPVIFRKAREFIEILF

SEQ ID NO: 255218 - protein, 25 aa, Homo sapiens
  Native (MAGC1_HUMAN)
VISRYTGYFPVIFRKAREFIEILFG

SEQ ID NO: 255219 - protein, 13 aa, Homo sapiens
  Native (MAGC1_HUMAN)
VIWDVLSGIGVRA

SEQ ID NO: 255220 - protein, 14 aa, Homo sapiens
  Native (MAGC1_HUMAN)
VIWDVLSGIGVRAG

SEQ ID NO: 255221 - protein, 15 aa, Homo sapiens
  Native (MAGC1_HUMAN)
VIWDVLSGIGVRAGR

SEQ ID NO: 255222 - protein, 16 aa, Homo sapiens
  Native (MAGC1_HUMAN)
VIWDVLSGIGVRAGRE

SEQ ID NO: 255223 - protein, 17 aa, Homo sapiens
  Native (MAGC1_HUMAN)
VIWDVLSGIGVRAGREH

SEQ ID NO: 255224 - protein, 18 aa, Homo sapiens
  Native (MAGC1_HUMAN)
VIWDVLSGIGVRAGREHF

SEQ ID NO: 255225 - protein, 19 aa, Homo sapiens
  Native (MAGC1_HUMAN)
VIWDVLSGIGVRAGREHFA

SEQ ID NO: 255226 - protein, 20 aa, Homo sapiens
  Native (MAGC1_HUMAN)
VIWDVLSGIGVRAGREHFAF

SEQ ID NO: 255227 - protein, 21 aa, Homo sapiens
  Native (MAGC1_HUMAN)
VIWDVLSGIGVRAGREHFAFG

SEQ ID NO: 255228 - protein, 22 aa, Homo sapiens
  Native (MAGC1_HUMAN)
VIWDVLSGIGVRAGREHFAFGE

SEQ ID NO: 255229 - protein, 23 aa, Homo sapiens
  Native (MAGC1_HUMAN)
VIWDVLSGIGVRAGREHFAFGEP

SEQ ID NO: 255230 - protein, 24 aa, Homo sapiens
  Native (MAGC1_HUMAN)
VIWDVLSGIGVRAGREHFAFGEPR

SEQ ID NO: 255231 - protein, 25 aa, Homo sapiens
  Native (MAGC1_HUMAN)
VIWDVLSGIGVRAGREHFAFGEPRE

SEQ ID NO: 255232 - protein, 14 aa, Homo sapiens
  Native (MAGC1_HUMAN)
VKQPITKAEMLTNV

SEQ ID NO: 255233 - protein, 15 aa, Homo sapiens
  Native (MAGC1_HUMAN)
VKQPITKAEMLTNVI

SEQ ID NO: 255234 - protein, 16 aa, Homo sapiens
  Native (MAGC1_HUMAN)
VKQPITKAEMLTNVIS

SEQ ID NO: 255235 - protein, 17 aa, Homo sapiens
  Native (MAGC1_HUMAN)
VKQPITKAEMLTNVISR

SEQ ID NO: 255236 - protein, 18 aa, Homo sapiens
  Native (MAGC1_HUMAN)
VKQPITKAEMLTNVISRY

SEQ ID NO: 255237 - protein, 19 aa, Homo sapiens
  Native (MAGC1_HUMAN)
VKQPITKAEMLTNVISRYT

SEQ ID NO: 255238 - protein, 20 aa, Homo sapiens
  Native (MAGC1_HUMAN)
VKQPITKAEMLTNVISRYTG

SEQ ID NO: 255239 - protein, 22 aa, Homo sapiens
  Native (MAGC1_HUMAN)
VKQPITKAEMLTNVISRYTGYF

SEQ ID NO: 255240 - protein, 23 aa, Homo sapiens
  Native (MAGC1_HUMAN)
VKQPITKAEMLTNVISRYTGYFP

SEQ ID NO: 255241 - protein, 24 aa, Homo sapiens
  Native (MAGC1_HUMAN)
VKQPITKAEMLTNVISRYTGYFPV

SEQ ID NO: 255242 - protein, 25 aa, Homo sapiens
  Native (MAGC1_HUMAN)
VKQPITKAEMLTNVISRYTGYFPVI

SEQ ID NO: 255243 - protein, 13 aa, Homo sapiens
  Native (MAGC1_HUMAN)
VLQIPVSAASSST

SEQ ID NO: 255244 - protein, 14 aa, Homo sapiens
  Native (MAGC1_HUMAN)
VLQIPVSAASSSTL

SEQ ID NO: 255245 - protein, 15 aa, Homo sapiens
  Native (MAGC1_HUMAN)
VLQIPVSAASSSTLV

SEQ ID NO: 255246 - protein, 16 aa, Homo sapiens
  Native (MAGC1_HUMAN)
VLQIPVSAASSSTLVS

SEQ ID NO: 255247 - protein, 17 aa, Homo sapiens
  Native (MAGC1_HUMAN)
VLQIPVSAASSSTLVSI

SEQ ID NO: 255248 - protein, 18 aa, Homo sapiens
  Native (MAGC1_HUMAN)
VLQIPVSAASSSTLVSIF

SEQ ID NO: 255249 - protein, 19 aa, Homo sapiens
  Native (MAGC1_HUMAN)
VLQIPVSAASSSTLVSIFQ

SEQ ID NO: 255250 - protein, 20 aa, Homo sapiens
  Native (MAGC1_HUMAN)
VLQIPVSAASSSTLVSIFQS

SEQ ID NO: 255251 - protein, 21 aa, Homo sapiens
  Native (MAGC1_HUMAN)
VLQIPVSAASSSTLVSIFQSS

SEQ ID NO: 255252 - protein, 22 aa, Homo sapiens
  Native (MAGC1_HUMAN)
VLQIPVSAASSSTLVSIFQSSP

SEQ ID NO: 255253 - protein, 23 aa, Homo sapiens
  Native (MAGC1_HUMAN)
VLQIPVSAASSSTLVSIFQSSPE

SEQ ID NO: 255254 - protein, 24 aa, Homo sapiens
  Native (MAGC1_HUMAN)
VLQIPVSAASSSTLVSIFQSSPES

SEQ ID NO: 255255 - protein, 25 aa, Homo sapiens
  Native (MAGC1_HUMAN)
VLQIPVSAASSSTLVSIFQSSPEST

SEQ ID NO: 255256 - protein, 13 aa, Homo sapiens
  Native (MAGC1_HUMAN)
VLSGIGVRAGREH

SEQ ID NO: 255257 - protein, 14 aa, Homo sapiens
  Native (MAGC1_HUMAN)
VLSGIGVRAGREHF

SEQ ID NO: 255258 - protein, 15 aa, Homo sapiens
  Native (MAGC1_HUMAN)
VLSGIGVRAGREHFA

SEQ ID NO: 255259 - protein, 16 aa, Homo sapiens
  Native (MAGC1_HUMAN)
VLSGIGVRAGREHFAF

SEQ ID NO: 255260 - protein, 17 aa, Homo sapiens
  Native (MAGC1_HUMAN)
VLSGIGVRAGREHFAFG

SEQ ID NO: 255261 - protein, 18 aa, Homo sapiens
  Native (MAGC1_HUMAN)
VLSGIGVRAGREHFAFGE

SEQ ID NO: 255262 - protein, 19 aa, Homo sapiens
  Native (MAGC1_HUMAN)
VLSGIGVRAGREHFAFGEP

SEQ ID NO: 255263 - protein, 20 aa, Homo sapiens
  Native (MAGC1_HUMAN)
VLSGIGVRAGREHFAFGEPR

SEQ ID NO: 255264 - protein, 21 aa, Homo sapiens
  Native (MAGC1_HUMAN)
VLSGIGVRAGREHFAFGEPRE

SEQ ID NO: 255265 - protein, 22 aa, Homo sapiens
  Native (MAGC1_HUMAN)
VLSGIGVRAGREHFAFGEPREL

SEQ ID NO: 255266 - protein, 23 aa, Homo sapiens
  Native (MAGC1_HUMAN)
VLSGIGVRAGREHFAFGEPRELL

SEQ ID NO: 255267 - protein, 24 aa, Homo sapiens
  Native (MAGC1_HUMAN)
VLSGIGVRAGREHFAFGEPRELLT

SEQ ID NO: 255268 - protein, 25 aa, Homo sapiens
  Native (MAGC1_HUMAN)
VLSGIGVRAGREHFAFGEPRELLTK

SEQ ID NO: 255269 - protein, 17 aa, Homo sapiens
  Native (MAGC1_HUMAN)
VPNSSPPRYEFLWGPRA

SEQ ID NO: 255270 - protein, 18 aa, Homo sapiens
  Native (MAGC1_HUMAN)
VPNSSPPRYEFLWGPRAH

SEQ ID NO: 255271 - protein, 19 aa, Homo sapiens
  Native (MAGC1_HUMAN)
VPNSSPPRYEFLWGPRAHS

SEQ ID NO: 255272 - protein, 20 aa, Homo sapiens
  Native (MAGC1_HUMAN)
VPNSSPPRYEFLWGPRAHSE

SEQ ID NO: 255273 - protein, 21 aa, Homo sapiens
  Native (MAGC1_HUMAN)
VPNSSPPRYEFLWGPRAHSEV

SEQ ID NO: 255274 - protein, 22 aa, Homo sapiens
  Native (MAGC1_HUMAN)
VPNSSPPRYEFLWGPRAHSEVI

SEQ ID NO: 255275 - protein, 23 aa, Homo sapiens
  Native (MAGC1_HUMAN)
VPNSSPPRYEFLWGPRAHSEVIK

SEQ ID NO: 255276 - protein, 24 aa, Homo sapiens
  Native (MAGC1_HUMAN)
VPNSSPPRYEFLWGPRAHSEVIKR

SEQ ID NO: 255277 - protein, 25 aa, Homo sapiens
  Native (MAGC1_HUMAN)
VPNSSPPRYEFLWGPRAHSEVIKRK

SEQ ID NO: 255278 - protein, 15 aa, Homo sapiens
  Native (MAGC1_HUMAN)
VQEHYLEYREVPNSS

SEQ ID NO: 255279 - protein, 19 aa, Homo sapiens
  Native (MAGC1_HUMAN)
VQEHYLEYREVPNSSPPRY

SEQ ID NO: 255280 - protein, 20 aa, Homo sapiens
  Native (MAGC1_HUMAN)
VQEHYLEYREVPNSSPPRYE

SEQ ID NO: 255281 - protein, 22 aa, Homo sapiens
  Native (MAGC1_HUMAN)
VQEHYLEYREVPNSSPPRYEFL

SEQ ID NO: 255282 - protein, 23 aa, Homo sapiens
  Native (MAGC1_HUMAN)
VQEHYLEYREVPNSSPPRYEFLW

SEQ ID NO: 255283 - protein, 24 aa, Homo sapiens
  Native (MAGC1_HUMAN)
VQEHYLEYREVPNSSPPRYEFLWG

SEQ ID NO: 255284 - protein, 25 aa, Homo sapiens
  Native (MAGC1_HUMAN)
VQEHYLEYREVPNSSPPRYEFLWGP

SEQ ID NO: 255285 - protein, 15 aa, Homo sapiens
  Native (MAGC1_HUMAN)
VQSPLQNPASSFFSS

SEQ ID NO: 255286 - protein, 16 aa, Homo sapiens
  Native (MAGC1_HUMAN)
VQSPLQNPASSFFSSA

SEQ ID NO: 255287 - protein, 17 aa, Homo sapiens
  Native (MAGC1_HUMAN)
VQSPLQNPASSFFSSAL

SEQ ID NO: 255288 - protein, 18 aa, Homo sapiens
  Native (MAGC1_HUMAN)
VQSPLQNPASSFFSSALL

SEQ ID NO: 255289 - protein, 19 aa, Homo sapiens
  Native (MAGC1_HUMAN)
VQSPLQNPASSFFSSALLS

SEQ ID NO: 255290 - protein, 20 aa, Homo sapiens
  Native (MAGC1_HUMAN)
VQSPLQNPASSFFSSALLSI

SEQ ID NO: 255291 - protein, 21 aa, Homo sapiens
  Native (MAGC1_HUMAN)
VQSPLQNPASSFFSSALLSIF

SEQ ID NO: 255292 - protein, 22 aa, Homo sapiens
  Native (MAGC1_HUMAN)
VQSPLQNPASSFFSSALLSIFQ

SEQ ID NO: 255293 - protein, 23 aa, Homo sapiens
  Native (MAGC1_HUMAN)
VQSPLQNPASSFFSSALLSIFQS

SEQ ID NO: 255294 - protein, 24 aa, Homo sapiens
  Native (MAGC1_HUMAN)
VQSPLQNPASSFFSSALLSIFQSS

SEQ ID NO: 255295 - protein, 25 aa, Homo sapiens
  Native (MAGC1_HUMAN)
VQSPLQNPASSFFSSALLSIFQSSP

SEQ ID NO: 255296 - protein, 16 aa, Homo sapiens
  Native (MAGC1_HUMAN)
VRAGREHFAFGEPREL

SEQ ID NO: 255297 - protein, 17 aa, Homo sapiens
  Native (MAGC1_HUMAN)
VRAGREHFAFGEPRELL

SEQ ID NO: 255298 - protein, 18 aa, Homo sapiens
  Native (MAGC1_HUMAN)
VRAGREHFAFGEPRELLT

SEQ ID NO: 255299 - protein, 19 aa, Homo sapiens
  Native (MAGC1_HUMAN)
VRAGREHFAFGEPRELLTK

SEQ ID NO: 255300 - protein, 20 aa, Homo sapiens
  Native (MAGC1_HUMAN)
VRAGREHFAFGEPRELLTKV

SEQ ID NO: 255301 - protein, 21 aa, Homo sapiens
  Native (MAGC1_HUMAN)
VRAGREHFAFGEPRELLTKVW

SEQ ID NO: 255302 - protein, 22 aa, Homo sapiens
  Native (MAGC1_HUMAN)
VRAGREHFAFGEPRELLTKVWV

SEQ ID NO: 255303 - protein, 23 aa, Homo sapiens
  Native (MAGC1_HUMAN)
VRAGREHFAFGEPRELLTKVWVQ

SEQ ID NO: 255304 - protein, 24 aa, Homo sapiens
  Native (MAGC1_HUMAN)
VRAGREHFAFGEPRELLTKVWVQE

SEQ ID NO: 255305 - protein, 25 aa, Homo sapiens
  Native (MAGC1_HUMAN)
VRAGREHFAFGEPRELLTKVWVQEH

SEQ ID NO: 255306 - protein, 13 aa, Homo sapiens
  Native (MAGC1_HUMAN)
VSAASSSTLVSIF

SEQ ID NO: 255307 - protein, 14 aa, Homo sapiens
  Native (MAGC1_HUMAN)
VSAASSSTLVSIFQ

SEQ ID NO: 255308 - protein, 15 aa, Homo sapiens
  Native (MAGC1_HUMAN)
VSAASSSTLVSIFQS

SEQ ID NO: 255309 - protein, 16 aa, Homo sapiens
  Native (MAGC1_HUMAN)
VSAASSSTLVSIFQSS

SEQ ID NO: 255310 - protein, 17 aa, Homo sapiens
  Native (MAGC1_HUMAN)
VSAASSSTLVSIFQSSP

SEQ ID NO: 255311 - protein, 18 aa, Homo sapiens
  Native (MAGC1_HUMAN)
VSAASSSTLVSIFQSSPE

SEQ ID NO: 255312 - protein, 19 aa, Homo sapiens
  Native (MAGC1_HUMAN)
VSAASSSTLVSIFQSSPES

SEQ ID NO: 255313 - protein, 20 aa, Homo sapiens
  Native (MAGC1_HUMAN)
VSAASSSTLVSIFQSSPEST

SEQ ID NO: 255314 - protein, 21 aa, Homo sapiens
  Native (MAGC1_HUMAN)
VSAASSSTLVSIFQSSPESTQ

SEQ ID NO: 255315 - protein, 22 aa, Homo sapiens
  Native (MAGC1_HUMAN)
VSAASSSTLVSIFQSSPESTQS

SEQ ID NO: 255316 - protein, 23 aa, Homo sapiens
  Native (MAGC1_HUMAN)
VSAASSSTLVSIFQSSPESTQSP

SEQ ID NO: 255317 - protein, 24 aa, Homo sapiens
  Native (MAGC1_HUMAN)
VSAASSSTLVSIFQSSPESTQSPF

SEQ ID NO: 255318 - protein, 25 aa, Homo sapiens
  Native (MAGC1_HUMAN)
VSAASSSTLVSIFQSSPESTQSPFE

SEQ ID NO: 255319 - protein, 13 aa, Homo sapiens
  Native (MAGC1_HUMAN)
VSICSSSTPSSLP

SEQ ID NO: 255320 - protein, 14 aa, Homo sapiens
  Native (MAGC1_HUMAN)
VSICSSSTPSSLPQ

SEQ ID NO: 255321 - protein, 15 aa, Homo sapiens
  Native (MAGC1_HUMAN)
VSICSSSTPSSLPQS

SEQ ID NO: 255322 - protein, 16 aa, Homo sapiens
  Native (MAGC1_HUMAN)
VSICSSSTPSSLPQSF

SEQ ID NO: 255323 - protein, 17 aa, Homo sapiens
  Native (MAGC1_HUMAN)
VSICSSSTPSSLPQSFP

SEQ ID NO: 255324 - protein, 18 aa, Homo sapiens
  Native (MAGC1_HUMAN)
VSICSSSTPSSLPQSFPE

SEQ ID NO: 255325 - protein, 19 aa, Homo sapiens
  Native (MAGC1_HUMAN)
VSICSSSTPSSLPQSFPES

SEQ ID NO: 255326 - protein, 20 aa, Homo sapiens
  Native (MAGC1_HUMAN)
VSICSSSTPSSLPQSFPESS

SEQ ID NO: 255327 - protein, 21 aa, Homo sapiens
  Native (MAGC1_HUMAN)
VSICSSSTPSSLPQSFPESSQ

SEQ ID NO: 255328 - protein, 22 aa, Homo sapiens
  Native (MAGC1_HUMAN)
VSICSSSTPSSLPQSFPESSQS

SEQ ID NO: 255329 - protein, 23 aa, Homo sapiens
  Native (MAGC1_HUMAN)
VSICSSSTPSSLPQSFPESSQSP

SEQ ID NO: 255330 - protein, 24 aa, Homo sapiens
  Native (MAGC1_HUMAN)
VSICSSSTPSSLPQSFPESSQSPP

SEQ ID NO: 255331 - protein, 25 aa, Homo sapiens
  Native (MAGC1_HUMAN)
VSICSSSTPSSLPQSFPESSQSPPE

SEQ ID NO: 255332 - protein, 13 aa, Homo sapiens
  Native (MAGC1_HUMAN)
VSICSSSTSLSLP

SEQ ID NO: 255333 - protein, 14 aa, Homo sapiens
  Native (MAGC1_HUMAN)
VSICSSSTSLSLPQ

SEQ ID NO: 255334 - protein, 15 aa, Homo sapiens
  Native (MAGC1_HUMAN)
VSICSSSTSLSLPQS

SEQ ID NO: 255335 - protein, 16 aa, Homo sapiens
  Native (MAGC1_HUMAN)
VSICSSSTSLSLPQSF

SEQ ID NO: 255336 - protein, 17 aa, Homo sapiens
  Native (MAGC1_HUMAN)
VSICSSSTSLSLPQSFP

SEQ ID NO: 255337 - protein, 18 aa, Homo sapiens
  Native (MAGC1_HUMAN)
VSICSSSTSLSLPQSFPE

SEQ ID NO: 255338 - protein, 19 aa, Homo sapiens
  Native (MAGC1_HUMAN)
VSICSSSTSLSLPQSFPES

SEQ ID NO: 255339 - protein, 20 aa, Homo sapiens
  Native (MAGC1_HUMAN)
VSICSSSTSLSLPQSFPESP

SEQ ID NO: 255340 - protein, 21 aa, Homo sapiens
  Native (MAGC1_HUMAN)
VSICSSSTSLSLPQSFPESPQ

SEQ ID NO: 255341 - protein, 22 aa, Homo sapiens
  Native (MAGC1_HUMAN)
VSICSSSTSLSLPQSFPESPQS

SEQ ID NO: 255342 - protein, 23 aa, Homo sapiens
  Native (MAGC1_HUMAN)
VSICSSSTSLSLPQSFPESPQSP

SEQ ID NO: 255343 - protein, 24 aa, Homo sapiens
  Native (MAGC1_HUMAN)
VSICSSSTSLSLPQSFPESPQSPP

SEQ ID NO: 255344 - protein, 25 aa, Homo sapiens
  Native (MAGC1_HUMAN)
VSICSSSTSLSLPQSFPESPQSPPE

SEQ ID NO: 255345 - protein, 14 aa, Homo sapiens
  Native (MAGC1_HUMAN)
VSIFQSSPESTQSP

SEQ ID NO: 255346 - protein, 15 aa, Homo sapiens
  Native (MAGC1_HUMAN)
VSIFQSSPESTQSPF

SEQ ID NO: 255347 - protein, 16 aa, Homo sapiens
  Native (MAGC1_HUMAN)
VSIFQSSPESTQSPFE

SEQ ID NO: 255348 - protein, 17 aa, Homo sapiens
  Native (MAGC1_HUMAN)
VSIFQSSPESTQSPFEG

SEQ ID NO: 255349 - protein, 20 aa, Homo sapiens
  Native (MAGC1_HUMAN)
VSIFQSSPESTQSPFEGFPQ

SEQ ID NO: 255350 - protein, 23 aa, Homo sapiens
  Native (MAGC1_HUMAN)
VSIFQSSPESTQSPFEGFPQSPL

SEQ ID NO: 255351 - protein, 24 aa, Homo sapiens
  Native (MAGC1_HUMAN)
VSIFQSSPESTQSPFEGFPQSPLQ

SEQ ID NO: 255352 - protein, 25 aa, Homo sapiens
  Native (MAGC1_HUMAN)
VSIFQSSPESTQSPFEGFPQSPLQI

SEQ ID NO: 255353 - protein, 15 aa, Homo sapiens
  Native (MAGC1_HUMAN)
VSLFQSSPERTQSTF

SEQ ID NO: 255354 - protein, 16 aa, Homo sapiens
  Native (MAGC1_HUMAN)
VSLFQSSPERTQSTFE

SEQ ID NO: 255355 - protein, 17 aa, Homo sapiens
  Native (MAGC1_HUMAN)
VSLFQSSPERTQSTFEG

SEQ ID NO: 255356 - protein, 19 aa, Homo sapiens
  Native (MAGC1_HUMAN)
VSLFQSSPERTQSTFEGFP

SEQ ID NO: 255357 - protein, 20 aa, Homo sapiens
  Native (MAGC1_HUMAN)
VSLFQSSPERTQSTFEGFPQ

SEQ ID NO: 255358 - protein, 21 aa, Homo sapiens
  Native (MAGC1_HUMAN)
VSLFQSSPERTQSTFEGFPQS

SEQ ID NO: 255359 - protein, 22 aa, Homo sapiens
  Native (MAGC1_HUMAN)
VSLFQSSPERTQSTFEGFPQSP

SEQ ID NO: 255360 - protein, 23 aa, Homo sapiens
  Native (MAGC1_HUMAN)
VSLFQSSPERTQSTFEGFPQSPL

SEQ ID NO: 255361 - protein, 24 aa, Homo sapiens
  Native (MAGC1_HUMAN)
VSLFQSSPERTQSTFEGFPQSPLQ

SEQ ID NO: 255362 - protein, 25 aa, Homo sapiens
  Native (MAGC1_HUMAN)
VSLFQSSPERTQSTFEGFPQSPLQI

SEQ ID NO: 255363 - protein, 13 aa, Homo sapiens
  Native (MAGC1_HUMAN)
VSPSFSSTLVSLF

SEQ ID NO: 255364 - protein, 14 aa, Homo sapiens
  Native (MAGC1_HUMAN)
VSPSFSSTLVSLFQ

SEQ ID NO: 255365 - protein, 15 aa, Homo sapiens
  Native (MAGC1_HUMAN)
VSPSFSSTLVSLFQS

SEQ ID NO: 255366 - protein, 16 aa, Homo sapiens
  Native (MAGC1_HUMAN)
VSPSFSSTLVSLFQSS

SEQ ID NO: 255367 - protein, 17 aa, Homo sapiens
  Native (MAGC1_HUMAN)
VSPSFSSTLVSLFQSSP

SEQ ID NO: 255368 - protein, 18 aa, Homo sapiens
  Native (MAGC1_HUMAN)
VSPSFSSTLVSLFQSSPE

SEQ ID NO: 255369 - protein, 19 aa, Homo sapiens
  Native (MAGC1_HUMAN)
VSPSFSSTLVSLFQSSPER

SEQ ID NO: 255370 - protein, 20 aa, Homo sapiens
  Native (MAGC1_HUMAN)
VSPSFSSTLVSLFQSSPERT

SEQ ID NO: 255371 - protein, 21 aa, Homo sapiens
  Native (MAGC1_HUMAN)
VSPSFSSTLVSLFQSSPERTQ

SEQ ID NO: 255372 - protein, 22 aa, Homo sapiens
  Native (MAGC1_HUMAN)
VSPSFSSTLVSLFQSSPERTQS

SEQ ID NO: 255373 - protein, 23 aa, Homo sapiens
  Native (MAGC1_HUMAN)
VSPSFSSTLVSLFQSSPERTQST

SEQ ID NO: 255374 - protein, 24 aa, Homo sapiens
  Native (MAGC1_HUMAN)
VSPSFSSTLVSLFQSSPERTQSTF

SEQ ID NO: 255375 - protein, 25 aa, Homo sapiens
  Native (MAGC1_HUMAN)
VSPSFSSTLVSLFQSSPERTQSTFE

SEQ ID NO: 255376 - protein, 13 aa, Homo sapiens
  Native (MAGC1_HUMAN)
VSPSSSSTLLSLF

SEQ ID NO: 255377 - protein, 14 aa, Homo sapiens
  Native (MAGC1_HUMAN)
VSPSSSSTLLSLFQ

SEQ ID NO: 255378 - protein, 15 aa, Homo sapiens
  Native (MAGC1_HUMAN)
VSPSSSSTLLSLFQS

SEQ ID NO: 255379 - protein, 16 aa, Homo sapiens
  Native (MAGC1_HUMAN)
VSPSSSSTLLSLFQSF

SEQ ID NO: 255380 - protein, 17 aa, Homo sapiens
  Native (MAGC1_HUMAN)
VSPSSSSTLLSLFQSFS

SEQ ID NO: 255381 - protein, 18 aa, Homo sapiens
  Native (MAGC1_HUMAN)
VSPSSSSTLLSLFQSFSE

SEQ ID NO: 255382 - protein, 19 aa, Homo sapiens
  Native (MAGC1_HUMAN)
VSPSSSSTLLSLFQSFSER

SEQ ID NO: 255383 - protein, 20 aa, Homo sapiens
  Native (MAGC1_HUMAN)
VSPSSSSTLLSLFQSFSERT

SEQ ID NO: 255384 - protein, 21 aa, Homo sapiens
  Native (MAGC1_HUMAN)
VSPSSSSTLLSLFQSFSERTQ

SEQ ID NO: 255385 - protein, 22 aa, Homo sapiens
  Native (MAGC1_HUMAN)
VSPSSSSTLLSLFQSFSERTQS

SEQ ID NO: 255386 - protein, 23 aa, Homo sapiens
  Native (MAGC1_HUMAN)
VSPSSSSTLLSLFQSFSERTQST

SEQ ID NO: 255387 - protein, 24 aa, Homo sapiens
  Native (MAGC1_HUMAN)
VSPSSSSTLLSLFQSFSERTQSTF

SEQ ID NO: 255388 - protein, 25 aa, Homo sapiens
  Native (MAGC1_HUMAN)
VSPSSSSTLLSLFQSFSERTQSTFE

SEQ ID NO: 255389 - protein, 13 aa, Homo sapiens
  Native (MAGC1_HUMAN)
VSRSFSSTLLSIF

SEQ ID NO: 255390 - protein, 14 aa, Homo sapiens
  Native (MAGC1_HUMAN)
VSRSFSSTLLSIFQ

SEQ ID NO: 255391 - protein, 15 aa, Homo sapiens
  Native (MAGC1_HUMAN)
VSRSFSSTLLSIFQS

SEQ ID NO: 255392 - protein, 16 aa, Homo sapiens
  Native (MAGC1_HUMAN)
VSRSFSSTLLSIFQSS

SEQ ID NO: 255393 - protein, 17 aa, Homo sapiens
  Native (MAGC1_HUMAN)
VSRSFSSTLLSIFQSSP

SEQ ID NO: 255394 - protein, 18 aa, Homo sapiens
  Native (MAGC1_HUMAN)
VSRSFSSTLLSIFQSSPE

SEQ ID NO: 255395 - protein, 19 aa, Homo sapiens
  Native (MAGC1_HUMAN)
VSRSFSSTLLSIFQSSPER

SEQ ID NO: 255396 - protein, 20 aa, Homo sapiens
  Native (MAGC1_HUMAN)
VSRSFSSTLLSIFQSSPERT

SEQ ID NO: 255397 - protein, 21 aa, Homo sapiens
  Native (MAGC1_HUMAN)
VSRSFSSTLLSIFQSSPERTQ

SEQ ID NO: 255398 - protein, 22 aa, Homo sapiens
  Native (MAGC1_HUMAN)
VSRSFSSTLLSIFQSSPERTQS

SEQ ID NO: 255399 - protein, 23 aa, Homo sapiens
  Native (MAGC1_HUMAN)
VSRSFSSTLLSIFQSSPERTQST

SEQ ID NO: 255400 - protein, 24 aa, Homo sapiens
  Native (MAGC1_HUMAN)
VSRSFSSTLLSIFQSSPERTQSTF

SEQ ID NO: 255401 - protein, 25 aa, Homo sapiens
  Native (MAGC1_HUMAN)
VSRSFSSTLLSIFQSSPERTQSTFE

SEQ ID NO: 255402 - protein, 13 aa, Homo sapiens
  Native (MAGC1_HUMAN)
VSSFFSYTLASLL

SEQ ID NO: 255403 - protein, 14 aa, Homo sapiens
  Native (MAGC1_HUMAN)
VSSFFSYTLASLLQ

SEQ ID NO: 255404 - protein, 15 aa, Homo sapiens
  Native (MAGC1_HUMAN)
VSSFFSYTLASLLQS

SEQ ID NO: 255405 - protein, 16 aa, Homo sapiens
  Native (MAGC1_HUMAN)
VSSFFSYTLASLLQSS

SEQ ID NO: 255406 - protein, 17 aa, Homo sapiens
  Native (MAGC1_HUMAN)
VSSFFSYTLASLLQSSH

SEQ ID NO: 255407 - protein, 18 aa, Homo sapiens
  Native (MAGC1_HUMAN)
VSSFFSYTLASLLQSSHE

SEQ ID NO: 255408 - protein, 19 aa, Homo sapiens
  Native (MAGC1_HUMAN)
VSSFFSYTLASLLQSSHES

SEQ ID NO: 255409 - protein, 20 aa, Homo sapiens
  Native (MAGC1_HUMAN)
VSSFFSYTLASLLQSSHESP

SEQ ID NO: 255410 - protein, 21 aa, Homo sapiens
  Native (MAGC1_HUMAN)
VSSFFSYTLASLLQSSHESPQ

SEQ ID NO: 255411 - protein, 22 aa, Homo sapiens
  Native (MAGC1_HUMAN)
VSSFFSYTLASLLQSSHESPQS

SEQ ID NO: 255412 - protein, 23 aa, Homo sapiens
  Native (MAGC1_HUMAN)
VSSFFSYTLASLLQSSHESPQSP

SEQ ID NO: 255413 - protein, 24 aa, Homo sapiens
  Native (MAGC1_HUMAN)
VSSFFSYTLASLLQSSHESPQSPP

SEQ ID NO: 255414 - protein, 25 aa, Homo sapiens
  Native (MAGC1_HUMAN)
VSSFFSYTLASLLQSSHESPQSPPE

SEQ ID NO: 255415 - protein, 14 aa, Homo sapiens
  Native (MAGC1_HUMAN)
VSSFPSSTSSSLSK

SEQ ID NO: 255416 - protein, 15 aa, Homo sapiens
  Native (MAGC1_HUMAN)
VSSFPSSTSSSLSKS

SEQ ID NO: 255417 - protein, 16 aa, Homo sapiens
  Native (MAGC1_HUMAN)
VSSFPSSTSSSLSKSS

SEQ ID NO: 255418 - protein, 17 aa, Homo sapiens
  Native (MAGC1_HUMAN)
VSSFPSSTSSSLSKSSP

SEQ ID NO: 255419 - protein, 18 aa, Homo sapiens
  Native (MAGC1_HUMAN)
VSSFPSSTSSSLSKSSPE

SEQ ID NO: 255420 - protein, 19 aa, Homo sapiens
  Native (MAGC1_HUMAN)
VSSFPSSTSSSLSKSSPES

SEQ ID NO: 255421 - protein, 20 aa, Homo sapiens
  Native (MAGC1_HUMAN)
VSSFPSSTSSSLSKSSPESP

SEQ ID NO: 255422 - protein, 21 aa, Homo sapiens
  Native (MAGC1_HUMAN)
VSSFPSSTSSSLSKSSPESPL

SEQ ID NO: 255423 - protein, 22 aa, Homo sapiens
  Native (MAGC1_HUMAN)
VSSFPSSTSSSLSKSSPESPLQ

SEQ ID NO: 255424 - protein, 23 aa, Homo sapiens
  Native (MAGC1_HUMAN)
VSSFPSSTSSSLSKSSPESPLQS

SEQ ID NO: 255425 - protein, 24 aa, Homo sapiens
  Native (MAGC1_HUMAN)
VSSFPSSTSSSLSKSSPESPLQSP

SEQ ID NO: 255426 - protein, 25 aa, Homo sapiens
  Native (MAGC1_HUMAN)
VSSFPSSTSSSLSKSSPESPLQSPV

SEQ ID NO: 255427 - protein, 14 aa, Homo sapiens
  Native (MAGC1_HUMAN)
VSSFPSSTSSSLSQ

SEQ ID NO: 255428 - protein, 15 aa, Homo sapiens
  Native (MAGC1_HUMAN)
VSSFPSSTSSSLSQS

SEQ ID NO: 255429 - protein, 16 aa, Homo sapiens
  Native (MAGC1_HUMAN)
VSSFPSSTSSSLSQSS

SEQ ID NO: 255430 - protein, 17 aa, Homo sapiens
  Native (MAGC1_HUMAN)
VSSFPSSTSSSLSQSSP

SEQ ID NO: 255431 - protein, 18 aa, Homo sapiens
  Native (MAGC1_HUMAN)
VSSFPSSTSSSLSQSSPV

SEQ ID NO: 255432 - protein, 19 aa, Homo sapiens
  Native (MAGC1_HUMAN)
VSSFPSSTSSSLSQSSPVS

SEQ ID NO: 255433 - protein, 20 aa, Homo sapiens
  Native (MAGC1_HUMAN)
VSSFPSSTSSSLSQSSPVSS

SEQ ID NO: 255434 - protein, 21 aa, Homo sapiens
  Native (MAGC1_HUMAN)
VSSFPSSTSSSLSQSSPVSSF

SEQ ID NO: 255435 - protein, 22 aa, Homo sapiens
  Native (MAGC1_HUMAN)
VSSFPSSTSSSLSQSSPVSSFP

SEQ ID NO: 255436 - protein, 23 aa, Homo sapiens
  Native (MAGC1_HUMAN)
VSSFPSSTSSSLSQSSPVSSFPS

SEQ ID NO: 255437 - protein, 24 aa, Homo sapiens
  Native (MAGC1_HUMAN)
VSSFPSSTSSSLSQSSPVSSFPSS

SEQ ID NO: 255438 - protein, 25 aa, Homo sapiens
  Native (MAGC1_HUMAN)
VSSFPSSTSSSLSQSSPVSSFPSST

SEQ ID NO: 255439 - protein, 13 aa, Homo sapiens
  Native (MAGC1_HUMAN)
VSSSFSYTLLSLF

SEQ ID NO: 255440 - protein, 14 aa, Homo sapiens
  Native (MAGC1_HUMAN)
VSSSFSYTLLSLFQ

SEQ ID NO: 255441 - protein, 15 aa, Homo sapiens
  Native (MAGC1_HUMAN)
VSSSFSYTLLSLFQS

SEQ ID NO: 255442 - protein, 16 aa, Homo sapiens
  Native (MAGC1_HUMAN)
VSSSFSYTLLSLFQSS

SEQ ID NO: 255443 - protein, 17 aa, Homo sapiens
  Native (MAGC1_HUMAN)
VSSSFSYTLLSLFQSSP

SEQ ID NO: 255444 - protein, 18 aa, Homo sapiens
  Native (MAGC1_HUMAN)
VSSSFSYTLLSLFQSSPE

SEQ ID NO: 255445 - protein, 19 aa, Homo sapiens
  Native (MAGC1_HUMAN)
VSSSFSYTLLSLFQSSPER

SEQ ID NO: 255446 - protein, 20 aa, Homo sapiens
  Native (MAGC1_HUMAN)
VSSSFSYTLLSLFQSSPERT

SEQ ID NO: 255447 - protein, 21 aa, Homo sapiens
  Native (MAGC1_HUMAN)
VSSSFSYTLLSLFQSSPERTH

SEQ ID NO: 255448 - protein, 22 aa, Homo sapiens
  Native (MAGC1_HUMAN)
VSSSFSYTLLSLFQSSPERTHS

SEQ ID NO: 255449 - protein, 23 aa, Homo sapiens
  Native (MAGC1_HUMAN)
VSSSFSYTLLSLFQSSPERTHST

SEQ ID NO: 255450 - protein, 24 aa, Homo sapiens
  Native (MAGC1_HUMAN)
VSSSFSYTLLSLFQSSPERTHSTF

SEQ ID NO: 255451 - protein, 25 aa, Homo sapiens
  Native (MAGC1_HUMAN)
VSSSFSYTLLSLFQSSPERTHSTFE

SEQ ID NO: 255452 - protein, 13 aa, Homo sapiens
  Native (MAGC1_HUMAN)
VSSSSSSSTLLSL

SEQ ID NO: 255453 - protein, 14 aa, Homo sapiens
  Native (MAGC1_HUMAN)
VSSSSSSSTLLSLF

SEQ ID NO: 255454 - protein, 15 aa, Homo sapiens
  Native (MAGC1_HUMAN)
VSSSSSSSTLLSLFQ

SEQ ID NO: 255455 - protein, 16 aa, Homo sapiens
  Native (MAGC1_HUMAN)
VSSSSSSSTLLSLFQS

SEQ ID NO: 255456 - protein, 17 aa, Homo sapiens
  Native (MAGC1_HUMAN)
VSSSSSSSTLLSLFQSS

SEQ ID NO: 255457 - protein, 18 aa, Homo sapiens
  Native (MAGC1_HUMAN)
VSSSSSSSTLLSLFQSSP

SEQ ID NO: 255458 - protein, 19 aa, Homo sapiens
  Native (MAGC1_HUMAN)
VSSSSSSSTLLSLFQSSPE

SEQ ID NO: 255459 - protein, 20 aa, Homo sapiens
  Native (MAGC1_HUMAN)
VSSSSSSSTLLSLFQSSPEC

SEQ ID NO: 255460 - protein, 21 aa, Homo sapiens
  Native (MAGC1_HUMAN)
VSSSSSSSTLLSLFQSSPECT

SEQ ID NO: 255461 - protein, 22 aa, Homo sapiens
  Native (MAGC1_HUMAN)
VSSSSSSSTLLSLFQSSPECTQ

SEQ ID NO: 255462 - protein, 23 aa, Homo sapiens
  Native (MAGC1_HUMAN)
VSSSSSSSTLLSLFQSSPECTQS

SEQ ID NO: 255463 - protein, 24 aa, Homo sapiens
  Native (MAGC1_HUMAN)
VSSSSSSSTLLSLFQSSPECTQST

SEQ ID NO: 255464 - protein, 25 aa, Homo sapiens
  Native (MAGC1_HUMAN)
VSSSSSSSTLLSLFQSSPECTQSTF

SEQ ID NO: 255465 - protein, 13 aa, Homo sapiens
  Native (MAGC1_HUMAN)
VSSSSSSTLLSLF

SEQ ID NO: 255466 - protein, 14 aa, Homo sapiens
  Native (MAGC1_HUMAN)
VSSSSSSTLLSLFQ

SEQ ID NO: 255467 - protein, 15 aa, Homo sapiens
  Native (MAGC1_HUMAN)
VSSSSSSTLLSLFQS

SEQ ID NO: 255468 - protein, 16 aa, Homo sapiens
  Native (MAGC1_HUMAN)
VSSSSSSTLLSLFQSS

SEQ ID NO: 255469 - protein, 17 aa, Homo sapiens
  Native (MAGC1_HUMAN)
VSSSSSSTLLSLFQSSP

SEQ ID NO: 255470 - protein, 18 aa, Homo sapiens
  Native (MAGC1_HUMAN)
VSSSSSSTLLSLFQSSPE

SEQ ID NO: 255471 - protein, 19 aa, Homo sapiens
  Native (MAGC1_HUMAN)
VSSSSSSTLLSLFQSSPER

SEQ ID NO: 255472 - protein, 20 aa, Homo sapiens
  Native (MAGC1_HUMAN)
VSSSSSSTLLSLFQSSPERT

SEQ ID NO: 255473 - protein, 21 aa, Homo sapiens
  Native (MAGC1_HUMAN)
VSSSSSSTLLSLFQSSPERTH

SEQ ID NO: 255474 - protein, 22 aa, Homo sapiens
  Native (MAGC1_HUMAN)
VSSSSSSTLLSLFQSSPERTHS

SEQ ID NO: 255475 - protein, 23 aa, Homo sapiens
  Native (MAGC1_HUMAN)
VSSSSSSTLLSLFQSSPERTHST

SEQ ID NO: 255476 - protein, 24 aa, Homo sapiens
  Native (MAGC1_HUMAN)
VSSSSSSTLLSLFQSSPERTHSTF

SEQ ID NO: 255477 - protein, 25 aa, Homo sapiens
  Native (MAGC1_HUMAN)
VSSSSSSTLLSLFQSSPERTHSTFE

SEQ ID NO: 255478 - protein, 13 aa, Homo sapiens
  Native (MAGC1_HUMAN)
VVEFLAMLKNTVP

SEQ ID NO: 255479 - protein, 14 aa, Homo sapiens
  Native (MAGC1_HUMAN)
VVEFLAMLKNTVPI

SEQ ID NO: 255480 - protein, 15 aa, Homo sapiens
  Native (MAGC1_HUMAN)
VVEFLAMLKNTVPIT

SEQ ID NO: 255481 - protein, 16 aa, Homo sapiens
  Native (MAGC1_HUMAN)
VVEFLAMLKNTVPITF

SEQ ID NO: 255482 - protein, 17 aa, Homo sapiens
  Native (MAGC1_HUMAN)
VVEFLAMLKNTVPITFP

SEQ ID NO: 255483 - protein, 18 aa, Homo sapiens
  Native (MAGC1_HUMAN)
VVEFLAMLKNTVPITFPS

SEQ ID NO: 255484 - protein, 19 aa, Homo sapiens
  Native (MAGC1_HUMAN)
VVEFLAMLKNTVPITFPSS

SEQ ID NO: 255485 - protein, 20 aa, Homo sapiens
  Native (MAGC1_HUMAN)
VVEFLAMLKNTVPITFPSSY

SEQ ID NO: 255486 - protein, 21 aa, Homo sapiens
  Native (MAGC1_HUMAN)
VVEFLAMLKNTVPITFPSSYK

SEQ ID NO: 255487 - protein, 22 aa, Homo sapiens
  Native (MAGC1_HUMAN)
VVEFLAMLKNTVPITFPSSYKD

SEQ ID NO: 255488 - protein, 23 aa, Homo sapiens
  Native (MAGC1_HUMAN)
VVEFLAMLKNTVPITFPSSYKDA

SEQ ID NO: 255489 - protein, 24 aa, Homo sapiens
  Native (MAGC1_HUMAN)
VVEFLAMLKNTVPITFPSSYKDAL

SEQ ID NO: 255490 - protein, 25 aa, Homo sapiens
  Native (MAGC1_HUMAN)
VVEFLAMLKNTVPITFPSSYKDALK

SEQ ID NO: 255491 - protein, 13 aa, Homo sapiens
  Native (MAGC1_HUMAN)
VWVQEHYLEYREV

SEQ ID NO: 255492 - protein, 14 aa, Homo sapiens
  Native (MAGC1_HUMAN)
VWVQEHYLEYREVP

SEQ ID NO: 255493 - protein, 15 aa, Homo sapiens
  Native (MAGC1_HUMAN)
VWVQEHYLEYREVPN

SEQ ID NO: 255494 - protein, 16 aa, Homo sapiens
  Native (MAGC1_HUMAN)
VWVQEHYLEYREVPNS

SEQ ID NO: 255495 - protein, 17 aa, Homo sapiens
  Native (MAGC1_HUMAN)
VWVQEHYLEYREVPNSS

SEQ ID NO: 255496 - protein, 18 aa, Homo sapiens
  Native (MAGC1_HUMAN)
VWVQEHYLEYREVPNSSP

SEQ ID NO: 255497 - protein, 19 aa, Homo sapiens
  Native (MAGC1_HUMAN)
VWVQEHYLEYREVPNSSPP

SEQ ID NO: 255498 - protein, 20 aa, Homo sapiens
  Native (MAGC1_HUMAN)
VWVQEHYLEYREVPNSSPPR

SEQ ID NO: 255499 - protein, 21 aa, Homo sapiens
  Native (MAGC1_HUMAN)
VWVQEHYLEYREVPNSSPPRY

SEQ ID NO: 255500 - protein, 22 aa, Homo sapiens
  Native (MAGC1_HUMAN)
VWVQEHYLEYREVPNSSPPRYE

SEQ ID NO: 255501 - protein, 23 aa, Homo sapiens
  Native (MAGC1_HUMAN)
VWVQEHYLEYREVPNSSPPRYEF

SEQ ID NO: 255502 - protein, 24 aa, Homo sapiens
  Native (MAGC1_HUMAN)
VWVQEHYLEYREVPNSSPPRYEFL

SEQ ID NO: 255503 - protein, 25 aa, Homo sapiens
  Native (MAGC1_HUMAN)
VWVQEHYLEYREVPNSSPPRYEFLW

SEQ ID NO: 255504 - protein, 13 aa, Homo sapiens
  Native (MAGC1_HUMAN)
WDVLSGIGVRAGR

SEQ ID NO: 255505 - protein, 14 aa, Homo sapiens
  Native (MAGC1_HUMAN)
WDVLSGIGVRAGRE

SEQ ID NO: 255506 - protein, 15 aa, Homo sapiens
  Native (MAGC1_HUMAN)
WDVLSGIGVRAGREH

SEQ ID NO: 255507 - protein, 17 aa, Homo sapiens
  Native (MAGC1_HUMAN)
WDVLSGIGVRAGREHFA

SEQ ID NO: 255508 - protein, 18 aa, Homo sapiens
  Native (MAGC1_HUMAN)
WDVLSGIGVRAGREHFAF

SEQ ID NO: 255509 - protein, 19 aa, Homo sapiens
  Native (MAGC1_HUMAN)
WDVLSGIGVRAGREHFAFG

SEQ ID NO: 255510 - protein, 20 aa, Homo sapiens
  Native (MAGC1_HUMAN)
WDVLSGIGVRAGREHFAFGE

SEQ ID NO: 255511 - protein, 21 aa, Homo sapiens
  Native (MAGC1_HUMAN)
WDVLSGIGVRAGREHFAFGEP

SEQ ID NO: 255512 - protein, 22 aa, Homo sapiens
  Native (MAGC1_HUMAN)
WDVLSGIGVRAGREHFAFGEPR

SEQ ID NO: 255513 - protein, 23 aa, Homo sapiens
  Native (MAGC1_HUMAN)
WDVLSGIGVRAGREHFAFGEPRE

SEQ ID NO: 255514 - protein, 24 aa, Homo sapiens
  Native (MAGC1_HUMAN)
WDVLSGIGVRAGREHFAFGEPREL

SEQ ID NO: 255515 - protein, 25 aa, Homo sapiens
  Native (MAGC1_HUMAN)
WDVLSGIGVRAGREHFAFGEPRELL

SEQ ID NO: 255516 - protein, 15 aa, Homo sapiens
  Native (MAGC1_HUMAN)
WEDSLSPLHFPQFPP

SEQ ID NO: 255517 - protein, 16 aa, Homo sapiens
  Native (MAGC1_HUMAN)
WEDSLSPLHFPQFPPQ

SEQ ID NO: 255518 - protein, 17 aa, Homo sapiens
  Native (MAGC1_HUMAN)
WEDSLSPLHFPQFPPQG

SEQ ID NO: 255519 - protein, 19 aa, Homo sapiens
  Native (MAGC1_HUMAN)
WEDSLSPLHFPQFPPQGED

SEQ ID NO: 255520 - protein, 20 aa, Homo sapiens
  Native (MAGC1_HUMAN)
WEDSLSPLHFPQFPPQGEDF

SEQ ID NO: 255521 - protein, 21 aa, Homo sapiens
  Native (MAGC1_HUMAN)
WEDSLSPLHFPQFPPQGEDFQ

SEQ ID NO: 255522 - protein, 22 aa, Homo sapiens
  Native (MAGC1_HUMAN)
WEDSLSPLHFPQFPPQGEDFQS

SEQ ID NO: 255523 - protein, 23 aa, Homo sapiens
  Native (MAGC1_HUMAN)
WEDSLSPLHFPQFPPQGEDFQSS

SEQ ID NO: 255524 - protein, 24 aa, Homo sapiens
  Native (MAGC1_HUMAN)
WEDSLSPLHFPQFPPQGEDFQSSL

SEQ ID NO: 255525 - protein, 25 aa, Homo sapiens
  Native (MAGC1_HUMAN)
WEDSLSPLHFPQFPPQGEDFQSSLQ

SEQ ID NO: 255526 - protein, 15 aa, Homo sapiens
  Native (MAGC1_HUMAN)
WGPRAHSEVIKRKVV

SEQ ID NO: 255527 - protein, 17 aa, Homo sapiens
  Native (MAGC1_HUMAN)
WGPRAHSEVIKRKVVEF

SEQ ID NO: 255528 - protein, 19 aa, Homo sapiens
  Native (MAGC1_HUMAN)
WGPRAHSEVIKRKVVEFLA

SEQ ID NO: 255529 - protein, 20 aa, Homo sapiens
  Native (MAGC1_HUMAN)
WGPRAHSEVIKRKVVEFLAM

SEQ ID NO: 255530 - protein, 21 aa, Homo sapiens
  Native (MAGC1_HUMAN)
WGPRAHSEVIKRKVVEFLAML

SEQ ID NO: 255531 - protein, 22 aa, Homo sapiens
  Native (MAGC1_HUMAN)
WGPRAHSEVIKRKVVEFLAMLK

SEQ ID NO: 255532 - protein, 23 aa, Homo sapiens
  Native (MAGC1_HUMAN)
WGPRAHSEVIKRKVVEFLAMLKN

SEQ ID NO: 255533 - protein, 24 aa, Homo sapiens
  Native (MAGC1_HUMAN)
WGPRAHSEVIKRKVVEFLAMLKNT

SEQ ID NO: 255534 - protein, 25 aa, Homo sapiens
  Native (MAGC1_HUMAN)
WGPRAHSEVIKRKVVEFLAMLKNTV

SEQ ID NO: 255535 - protein, 13 aa, Homo sapiens
  Native (MAGC1_HUMAN)
WVQEHYLEYREVP

SEQ ID NO: 255536 - protein, 14 aa, Homo sapiens
  Native (MAGC1_HUMAN)
WVQEHYLEYREVPN

SEQ ID NO: 255537 - protein, 15 aa, Homo sapiens
  Native (MAGC1_HUMAN)
WVQEHYLEYREVPNS

SEQ ID NO: 255538 - protein, 16 aa, Homo sapiens
  Native (MAGC1_HUMAN)
WVQEHYLEYREVPNSS

SEQ ID NO: 255539 - protein, 17 aa, Homo sapiens
  Native (MAGC1_HUMAN)
WVQEHYLEYREVPNSSP

SEQ ID NO: 255540 - protein, 19 aa, Homo sapiens
  Native (MAGC1_HUMAN)
WVQEHYLEYREVPNSSPPR

SEQ ID NO: 255541 - protein, 20 aa, Homo sapiens
  Native (MAGC1_HUMAN)
WVQEHYLEYREVPNSSPPRY

SEQ ID NO: 255542 - protein, 21 aa, Homo sapiens
  Native (MAGC1_HUMAN)
WVQEHYLEYREVPNSSPPRYE

SEQ ID NO: 255543 - protein, 22 aa, Homo sapiens
  Native (MAGC1_HUMAN)
WVQEHYLEYREVPNSSPPRYEF

SEQ ID NO: 255544 - protein, 23 aa, Homo sapiens
  Native (MAGC1_HUMAN)
WVQEHYLEYREVPNSSPPRYEFL

SEQ ID NO: 255545 - protein, 24 aa, Homo sapiens
  Native (MAGC1_HUMAN)
WVQEHYLEYREVPNSSPPRYEFLW

SEQ ID NO: 255546 - protein, 25 aa, Homo sapiens
  Native (MAGC1_HUMAN)
WVQEHYLEYREVPNSSPPRYEFLWG

SEQ ID NO: 255547 - protein, 14 aa, Homo sapiens
  Native (MAGC1_HUMAN)
YASEEVIWDVLSGI

SEQ ID NO: 255548 - protein, 15 aa, Homo sapiens
  Native (MAGC1_HUMAN)
YASEEVIWDVLSGIG

SEQ ID NO: 255549 - protein, 16 aa, Homo sapiens
  Native (MAGC1_HUMAN)
YASEEVIWDVLSGIGV

SEQ ID NO: 255550 - protein, 17 aa, Homo sapiens
  Native (MAGC1_HUMAN)
YASEEVIWDVLSGIGVR

SEQ ID NO: 255551 - protein, 18 aa, Homo sapiens
  Native (MAGC1_HUMAN)
YASEEVIWDVLSGIGVRA

SEQ ID NO: 255552 - protein, 19 aa, Homo sapiens
  Native (MAGC1_HUMAN)
YASEEVIWDVLSGIGVRAG

SEQ ID NO: 255553 - protein, 20 aa, Homo sapiens
  Native (MAGC1_HUMAN)
YASEEVIWDVLSGIGVRAGR

SEQ ID NO: 255554 - protein, 21 aa, Homo sapiens
  Native (MAGC1_HUMAN)
YASEEVIWDVLSGIGVRAGRE

SEQ ID NO: 255555 - protein, 22 aa, Homo sapiens
  Native (MAGC1_HUMAN)
YASEEVIWDVLSGIGVRAGREH

SEQ ID NO: 255556 - protein, 23 aa, Homo sapiens
  Native (MAGC1_HUMAN)
YASEEVIWDVLSGIGVRAGREHF

SEQ ID NO: 255557 - protein, 24 aa, Homo sapiens
  Native (MAGC1_HUMAN)
YASEEVIWDVLSGIGVRAGREHFA

SEQ ID NO: 255558 - protein, 25 aa, Homo sapiens
  Native (MAGC1_HUMAN)
YASEEVIWDVLSGIGVRAGREHFAF

SEQ ID NO: 255559 - protein, 13 aa, Homo sapiens
  Native (MAGC1_HUMAN)
YEFLWGPRAHSEV

SEQ ID NO: 255560 - protein, 14 aa, Homo sapiens
  Native (MAGC1_HUMAN)
YEFLWGPRAHSEVI

SEQ ID NO: 255561 - protein, 15 aa, Homo sapiens
  Native (MAGC1_HUMAN)
YEFLWGPRAHSEVIK

SEQ ID NO: 255562 - protein, 16 aa, Homo sapiens
  Native (MAGC1_HUMAN)
YEFLWGPRAHSEVIKR

SEQ ID NO: 255563 - protein, 17 aa, Homo sapiens
  Native (MAGC1_HUMAN)
YEFLWGPRAHSEVIKRK

SEQ ID NO: 255564 - protein, 18 aa, Homo sapiens
  Native (MAGC1_HUMAN)
YEFLWGPRAHSEVIKRKV

SEQ ID NO: 255565 - protein, 19 aa, Homo sapiens
  Native (MAGC1_HUMAN)
YEFLWGPRAHSEVIKRKVV

SEQ ID NO: 255566 - protein, 20 aa, Homo sapiens
  Native (MAGC1_HUMAN)
YEFLWGPRAHSEVIKRKVVE

SEQ ID NO: 255567 - protein, 21 aa, Homo sapiens
  Native (MAGC1_HUMAN)
YEFLWGPRAHSEVIKRKVVEF

SEQ ID NO: 255568 - protein, 22 aa, Homo sapiens
  Native (MAGC1_HUMAN)
YEFLWGPRAHSEVIKRKVVEFL

SEQ ID NO: 255569 - protein, 23 aa, Homo sapiens
  Native (MAGC1_HUMAN)
YEFLWGPRAHSEVIKRKVVEFLA

SEQ ID NO: 255570 - protein, 24 aa, Homo sapiens
  Native (MAGC1_HUMAN)
YEFLWGPRAHSEVIKRKVVEFLAM

SEQ ID NO: 255571 - protein, 25 aa, Homo sapiens
  Native (MAGC1_HUMAN)
YEFLWGPRAHSEVIKRKVVEFLAML

SEQ ID NO: 255572 - protein, 15 aa, Homo sapiens
  Native (MAGC1_HUMAN)
YFPQSPLQGEEFQSS

SEQ ID NO: 255573 - protein, 16 aa, Homo sapiens
  Native (MAGC1_HUMAN)
YFPQSPLQGEEFQSSL

SEQ ID NO: 255574 - protein, 17 aa, Homo sapiens
  Native (MAGC1_HUMAN)
YFPQSPLQGEEFQSSLQ

SEQ ID NO: 255575 - protein, 18 aa, Homo sapiens
  Native (MAGC1_HUMAN)
YFPQSPLQGEEFQSSLQS

SEQ ID NO: 255576 - protein, 19 aa, Homo sapiens
  Native (MAGC1_HUMAN)
YFPQSPLQGEEFQSSLQSP

SEQ ID NO: 255577 - protein, 20 aa, Homo sapiens
  Native (MAGC1_HUMAN)
YFPQSPLQGEEFQSSLQSPV

SEQ ID NO: 255578 - protein, 21 aa, Homo sapiens
  Native (MAGC1_HUMAN)
YFPQSPLQGEEFQSSLQSPVS

SEQ ID NO: 255579 - protein, 22 aa, Homo sapiens
  Native (MAGC1_HUMAN)
YFPQSPLQGEEFQSSLQSPVSI

SEQ ID NO: 255580 - protein, 23 aa, Homo sapiens
  Native (MAGC1_HUMAN)
YFPQSPLQGEEFQSSLQSPVSIC

SEQ ID NO: 255581 - protein, 24 aa, Homo sapiens
  Native (MAGC1_HUMAN)
YFPQSPLQGEEFQSSLQSPVSICS

SEQ ID NO: 255582 - protein, 25 aa, Homo sapiens
  Native (MAGC1_HUMAN)
YFPQSPLQGEEFQSSLQSPVSICSS

SEQ ID NO: 255583 - protein, 25 aa, Homo sapiens
  Native (MAGC1_HUMAN)
YFPQSPPQGEDSMSPLYFPQSPLQG

SEQ ID NO: 255584 - protein, 13 aa, Homo sapiens
  Native (MAGC1_HUMAN)
YFPVIFRKAREFI

SEQ ID NO: 255585 - protein, 14 aa, Homo sapiens
  Native (MAGC1_HUMAN)
YFPVIFRKAREFIE

SEQ ID NO: 255586 - protein, 15 aa, Homo sapiens
  Native (MAGC1_HUMAN)
YFPVIFRKAREFIEI

SEQ ID NO: 255587 - protein, 16 aa, Homo sapiens
  Native (MAGC1_HUMAN)
YFPVIFRKAREFIEIL

SEQ ID NO: 255588 - protein, 17 aa, Homo sapiens
  Native (MAGC1_HUMAN)
YFPVIFRKAREFIEILF

SEQ ID NO: 255589 - protein, 18 aa, Homo sapiens
  Native (MAGC1_HUMAN)
YFPVIFRKAREFIEILFG

SEQ ID NO: 255590 - protein, 19 aa, Homo sapiens
  Native (MAGC1_HUMAN)
YFPVIFRKAREFIEILFGI

SEQ ID NO: 255591 - protein, 20 aa, Homo sapiens
  Native (MAGC1_HUMAN)
YFPVIFRKAREFIEILFGIS

SEQ ID NO: 255592 - protein, 21 aa, Homo sapiens
  Native (MAGC1_HUMAN)
YFPVIFRKAREFIEILFGISL

SEQ ID NO: 255593 - protein, 22 aa, Homo sapiens
  Native (MAGC1_HUMAN)
YFPVIFRKAREFIEILFGISLR

SEQ ID NO: 255594 - protein, 23 aa, Homo sapiens
  Native (MAGC1_HUMAN)
YFPVIFRKAREFIEILFGISLRE

SEQ ID NO: 255595 - protein, 24 aa, Homo sapiens
  Native (MAGC1_HUMAN)
YFPVIFRKAREFIEILFGISLREV

SEQ ID NO: 255596 - protein, 25 aa, Homo sapiens
  Native (MAGC1_HUMAN)
YFPVIFRKAREFIEILFGISLREVD

SEQ ID NO: 255597 - protein, 25 aa, Homo sapiens
  Native (MAGC1_HUMAN)
YKDALKDVEERAQAIIDTTDDSTAT

SEQ ID NO: 255598 - protein, 14 aa, Homo sapiens
  Native (MAGC1_HUMAN)
YLEYREVPNSSPPR

SEQ ID NO: 255599 - protein, 15 aa, Homo sapiens
  Native (MAGC1_HUMAN)
YLEYREVPNSSPPRY

SEQ ID NO: 255600 - protein, 16 aa, Homo sapiens
  Native (MAGC1_HUMAN)
YLEYREVPNSSPPRYE

SEQ ID NO: 255601 - protein, 17 aa, Homo sapiens
  Native (MAGC1_HUMAN)
YLEYREVPNSSPPRYEF

SEQ ID NO: 255602 - protein, 20 aa, Homo sapiens
  Native (MAGC1_HUMAN)
YLEYREVPNSSPPRYEFLWG

SEQ ID NO: 255603 - protein, 23 aa, Homo sapiens
  Native (MAGC1_HUMAN)
YLEYREVPNSSPPRYEFLWGPRA

SEQ ID NO: 255604 - protein, 24 aa, Homo sapiens
  Native (MAGC1_HUMAN)
YLEYREVPNSSPPRYEFLWGPRAH

SEQ ID NO: 255605 - protein, 25 aa, Homo sapiens
  Native (MAGC1_HUMAN)
YLEYREVPNSSPPRYEFLWGPRAHS

SEQ ID NO: 255606 - protein, 15 aa, Homo sapiens
  Native (MAGC1_HUMAN)
YQVKQPITKAEMLTN

SEQ ID NO: 255607 - protein, 16 aa, Homo sapiens
  Native (MAGC1_HUMAN)
YQVKQPITKAEMLTNV

SEQ ID NO: 255608 - protein, 17 aa, Homo sapiens
  Native (MAGC1_HUMAN)
YQVKQPITKAEMLTNVI

SEQ ID NO: 255609 - protein, 19 aa, Homo sapiens
  Native (MAGC1_HUMAN)
YQVKQPITKAEMLTNVISR

SEQ ID NO: 255610 - protein, 20 aa, Homo sapiens
  Native (MAGC1_HUMAN)
YQVKQPITKAEMLTNVISRY

SEQ ID NO: 255611 - protein, 21 aa, Homo sapiens
  Native (MAGC1_HUMAN)
YQVKQPITKAEMLTNVISRYT

SEQ ID NO: 255612 - protein, 22 aa, Homo sapiens
  Native (MAGC1_HUMAN)
YQVKQPITKAEMLTNVISRYTG

SEQ ID NO: 255613 - protein, 23 aa, Homo sapiens
  Native (MAGC1_HUMAN)
YQVKQPITKAEMLTNVISRYTGY

SEQ ID NO: 255614 - protein, 24 aa, Homo sapiens
  Native (MAGC1_HUMAN)
YQVKQPITKAEMLTNVISRYTGYF

SEQ ID NO: 255615 - protein, 25 aa, Homo sapiens
  Native (MAGC1_HUMAN)
YQVKQPITKAEMLTNVISRYTGYFP

SEQ ID NO: 255616 - protein, 20 aa, Homo sapiens
  Native (MAGC1_HUMAN)
YREVPNSSPPRYEFLWGPRA

SEQ ID NO: 255617 - protein, 21 aa, Homo sapiens
  Native (MAGC1_HUMAN)
YREVPNSSPPRYEFLWGPRAH

SEQ ID NO: 255618 - protein, 22 aa, Homo sapiens
  Native (MAGC1_HUMAN)
YREVPNSSPPRYEFLWGPRAHS

SEQ ID NO: 255619 - protein, 23 aa, Homo sapiens
  Native (MAGC1_HUMAN)
YREVPNSSPPRYEFLWGPRAHSE

SEQ ID NO: 255620 - protein, 24 aa, Homo sapiens
  Native (MAGC1_HUMAN)
YREVPNSSPPRYEFLWGPRAHSEV

SEQ ID NO: 255621 - protein, 25 aa, Homo sapiens
  Native (MAGC1_HUMAN)
YREVPNSSPPRYEFLWGPRAHSEVI

SEQ ID NO: 255622 - protein, 13 aa, Homo sapiens
  Native (MAGC1_HUMAN)
YTGYFPVIFRKAR

SEQ ID NO: 255623 - protein, 14 aa, Homo sapiens
  Native (MAGC1_HUMAN)
YTGYFPVIFRKARE

SEQ ID NO: 255624 - protein, 15 aa, Homo sapiens
  Native (MAGC1_HUMAN)
YTGYFPVIFRKAREF

SEQ ID NO: 255625 - protein, 16 aa, Homo sapiens
  Native (MAGC1_HUMAN)
YTGYFPVIFRKAREFI

SEQ ID NO: 255626 - protein, 17 aa, Homo sapiens
  Native (MAGC1_HUMAN)
YTGYFPVIFRKAREFIE

SEQ ID NO: 255627 - protein, 18 aa, Homo sapiens
  Native (MAGC1_HUMAN)
YTGYFPVIFRKAREFIEI

SEQ ID NO: 255628 - protein, 19 aa, Homo sapiens
  Native (MAGC1_HUMAN)
YTGYFPVIFRKAREFIEIL

SEQ ID NO: 255629 - protein, 20 aa, Homo sapiens
  Native (MAGC1_HUMAN)
YTGYFPVIFRKAREFIEILF

SEQ ID NO: 255630 - protein, 21 aa, Homo sapiens
  Native (MAGC1_HUMAN)
YTGYFPVIFRKAREFIEILFG

SEQ ID NO: 255631 - protein, 22 aa, Homo sapiens
  Native (MAGC1_HUMAN)
YTGYFPVIFRKAREFIEILFGI

SEQ ID NO: 255632 - protein, 23 aa, Homo sapiens
  Native (MAGC1_HUMAN)
YTGYFPVIFRKAREFIEILFGIS

SEQ ID NO: 255633 - protein, 24 aa, Homo sapiens
  Native (MAGC1_HUMAN)
YTGYFPVIFRKAREFIEILFGISL

SEQ ID NO: 255634 - protein, 25 aa, Homo sapiens
  Native (MAGC1_HUMAN)
YTGYFPVIFRKAREFIEILFGISLR

SEQ ID NO: 255635 - protein, 13 aa, Homo sapiens
  Native (MAGC1_HUMAN)
YTLASLLQSSHES

SEQ ID NO: 255636 - protein, 14 aa, Homo sapiens
  Native (MAGC1_HUMAN)
YTLASLLQSSHESP

SEQ ID NO: 255637 - protein, 15 aa, Homo sapiens
  Native (MAGC1_HUMAN)
YTLASLLQSSHESPQ

SEQ ID NO: 255638 - protein, 16 aa, Homo sapiens
  Native (MAGC1_HUMAN)
YTLASLLQSSHESPQS

SEQ ID NO: 255639 - protein, 17 aa, Homo sapiens
  Native (MAGC1_HUMAN)
YTLASLLQSSHESPQSP

SEQ ID NO: 255640 - protein, 18 aa, Homo sapiens
  Native (MAGC1_HUMAN)
YTLASLLQSSHESPQSPP

SEQ ID NO: 255641 - protein, 19 aa, Homo sapiens
  Native (MAGC1_HUMAN)
YTLASLLQSSHESPQSPPE

SEQ ID NO: 255642 - protein, 20 aa, Homo sapiens
  Native (MAGC1_HUMAN)
YTLASLLQSSHESPQSPPEG

SEQ ID NO: 255643 - protein, 15 aa, Homo sapiens
  Native (MAGC1_HUMAN)
YTLDEKVDELARFLL

SEQ ID NO: 255644 - protein, 16 aa, Homo sapiens
  Native (MAGC1_HUMAN)
YTLDEKVDELARFLLL

SEQ ID NO: 255645 - protein, 17 aa, Homo sapiens
  Native (MAGC1_HUMAN)
YTLDEKVDELARFLLLK

SEQ ID NO: 255646 - protein, 18 aa, Homo sapiens
  Native (MAGC1_HUMAN)
YTLDEKVDELARFLLLKY

SEQ ID NO: 255647 - protein, 19 aa, Homo sapiens
  Native (MAGC1_HUMAN)
YTLDEKVDELARFLLLKYQ

SEQ ID NO: 255648 - protein, 20 aa, Homo sapiens
  Native (MAGC1_HUMAN)
YTLDEKVDELARFLLLKYQV

SEQ ID NO: 255649 - protein, 21 aa, Homo sapiens
  Native (MAGC1_HUMAN)
YTLDEKVDELARFLLLKYQVK

SEQ ID NO: 255650 - protein, 22 aa, Homo sapiens
  Native (MAGC1_HUMAN)
YTLDEKVDELARFLLLKYQVKQ

SEQ ID NO: 255651 - protein, 23 aa, Homo sapiens
  Native (MAGC1_HUMAN)
YTLDEKVDELARFLLLKYQVKQP

SEQ ID NO: 255652 - protein, 24 aa, Homo sapiens
  Native (MAGC1_HUMAN)
YTLDEKVDELARFLLLKYQVKQPI

SEQ ID NO: 255653 - protein, 25 aa, Homo sapiens
  Native (MAGC1_HUMAN)
YTLDEKVDELARFLLLKYQVKQPIT

SEQ ID NO: 255654 - protein, 13 aa, Homo sapiens
  Native (MAGC1_HUMAN)
YTLLSLFQSSPER

SEQ ID NO: 255655 - protein, 14 aa, Homo sapiens
  Native (MAGC1_HUMAN)
YTLLSLFQSSPERT

SEQ ID NO: 255656 - protein, 16 aa, Homo sapiens
  Native (MAGC1_HUMAN)
YTLLSLFQSSPERTHS

SEQ ID NO: 255657 - protein, 17 aa, Homo sapiens
  Native (MAGC1_HUMAN)
YTLLSLFQSSPERTHST

SEQ ID NO: 255658 - protein, 18 aa, Homo sapiens
  Native (MAGC1_HUMAN)
YTLLSLFQSSPERTHSTF

SEQ ID NO: 255659 - protein, 19 aa, Homo sapiens
  Native (MAGC1_HUMAN)
YTLLSLFQSSPERTHSTFE

SEQ ID NO: 255660 - protein, 20 aa, Homo sapiens
  Native (MAGC1_HUMAN)
YTLLSLFQSSPERTHSTFEG

SEQ ID NO: 255661 - protein, 21 aa, Homo sapiens
  Native (MAGC1_HUMAN)
YTLLSLFQSSPERTHSTFEGF

SEQ ID NO: 255662 - protein, 22 aa, Homo sapiens
  Native (MAGC1_HUMAN)
YTLLSLFQSSPERTHSTFEGFP

SEQ ID NO: 255663 - protein, 23 aa, Homo sapiens
  Native (MAGC1_HUMAN)
YTLLSLFQSSPERTHSTFEGFPQ

SEQ ID NO: 255664 - protein, 24 aa, Homo sapiens
  Native (MAGC1_HUMAN)
YTLLSLFQSSPERTHSTFEGFPQS

SEQ ID NO: 255665 - protein, 25 aa, Homo sapiens
  Native (MAGC1_HUMAN)
YTLLSLFQSSPERTHSTFEGFPQSP

SEQ ID NO: 255666 - protein, 20 aa, Homo sapiens
  Native (MAGC1_HUMAN)
YTSSSDTLLESDSLTDSESL

SEQ ID NO: 255667 - protein, 13 aa, Homo sapiens
  Native (MAGC1_HUMAN)
YVFVNTLDLTSEG

SEQ ID NO: 255668 - protein, 14 aa, Homo sapiens
  Native (MAGC1_HUMAN)
YVFVNTLDLTSEGC

SEQ ID NO: 255669 - protein, 15 aa, Homo sapiens
  Native (MAGC1_HUMAN)
YVFVNTLDLTSEGCL

SEQ ID NO: 255670 - protein, 16 aa, Homo sapiens
  Native (MAGC1_HUMAN)
YVFVNTLDLTSEGCLS

SEQ ID NO: 255671 - protein, 17 aa, Homo sapiens
  Native (MAGC1_HUMAN)
YVFVNTLDLTSEGCLSD

SEQ ID NO: 255672 - protein, 18 aa, Homo sapiens
  Native (MAGC1_HUMAN)
YVFVNTLDLTSEGCLSDE

SEQ ID NO: 255673 - protein, 19 aa, Homo sapiens
  Native (MAGC1_HUMAN)
YVFVNTLDLTSEGCLSDEQ

SEQ ID NO: 255674 - protein, 20 aa, Homo sapiens
  Native (MAGC1_HUMAN)
YVFVNTLDLTSEGCLSDEQG

SEQ ID NO: 255675 - protein, 21 aa, Homo sapiens
  Native (MAGC1_HUMAN)
YVFVNTLDLTSEGCLSDEQGM

SEQ ID NO: 255676 - protein, 22 aa, Homo sapiens
  Native (MAGC1_HUMAN)
YVFVNTLDLTSEGCLSDEQGMS

SEQ ID NO: 255677 - protein, 23 aa, Homo sapiens
  Native (MAGC1_HUMAN)
YVFVNTLDLTSEGCLSDEQGMSQ

SEQ ID NO: 255678 - protein, 24 aa, Homo sapiens
  Native (MAGC1_HUMAN)
YVFVNTLDLTSEGCLSDEQGMSQN

SEQ ID NO: 255679 - protein, 25 aa, Homo sapiens
  Native (MAGC1_HUMAN)
YVFVNTLDLTSEGCLSDEQGMSQNR

SEQ ID NO: 255680 - protein, 17 aa, Artificial Sequence
  Description of Artificial Sequence: Synthetic peptide
  Seed: IKRKVVEFLAMLKNTVP (MAGC1_HUMAN)
  Core: RKVVEFLAM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
IKXKVXEXLAXLKNTVP

SEQ ID NO: 255681 - protein, 17 aa, Artificial Sequence
  Description of Artificial Sequence: Synthetic peptide
  Seed: IKRKVVEFLAMLKNTVP (MAGC1_HUMAN)
  Core: KVVEFLAML
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
IKRXVVXFXAMXKNTVP

SEQ ID NO: 255682 - protein, 17 aa, Artificial Sequence
  Description of Artificial Sequence: Synthetic peptide
  Seed: IKRKVVEFLAMLKNTVP (MAGC1_HUMAN)
  Core: VVEFLAMLK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
IKRKXVEXLXMLXNTVP

SEQ ID NO: 255683 - protein, 17 aa, Artificial Sequence
  Description of Artificial Sequence: Synthetic peptide
  Seed: IKRKVVEFLAMLKNTVP (MAGC1_HUMAN)
  Core: VEFLAMLKN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
IKRKVXEFXAXLKXTVP

SEQ ID NO: 255684 - protein, 17 aa, Artificial Sequence
  Description of Artificial Sequence: Synthetic peptide
  Seed: IKRKVVEFLAMLKNTVP (MAGC1_HUMAN)
  Core: FLAMLKNTV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
IKRKVVEXLAXLXNTXP

SEQ ID NO: 255685 - protein, 15 aa, Artificial Sequence
  Description of Artificial Sequence: Synthetic peptide
  Seed: SFFSYTLASLLQSSH (MAGC1_HUMAN)
  Core: FSYTLASLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
SFXSYXLXSLXQSSH

SEQ ID NO: 255686 - protein, 15 aa, Artificial Sequence
  Description of Artificial Sequence: Synthetic peptide
  Seed: SFFSYTLASLLQSSH (MAGC1_HUMAN)
  Core: YTLASLLQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SFFSXTLXSXLQXSH

SEQ ID NO: 255687 - protein, 15 aa, Artificial Sequence
  Description of Artificial Sequence: Synthetic peptide
  Seed: SFFSYTLASLLQSSH (MAGC1_HUMAN)
  Core: TLASLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, Ile, Lys, Leu, Met, Asn, Pro, Gln, Ser, Thr, Val, Trp, or Ty r
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SFFSYXLAXLXQSXH

SEQ ID NO: 255688 - protein, 13 aa, Artificial Sequence
  Description of Artificial Sequence: Synthetic peptide
  Seed: AASSSTLVSIFQS (MAGC1_HUMAN)
  Core: ASSSTLVSI
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXSSXTXVSXFQS

SEQ ID NO: 255689 - protein, 14 aa, Artificial Sequence
  Description of Artificial Sequence: Synthetic peptide
  Seed: AASSSTLVSIFQSS (MAGC1_HUMAN)
  Core: SSSTLVSIF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AAXSSXLXSIXQSS

SEQ ID NO: 255690 - protein, 14 aa, Artificial Sequence
  Description of Artificial Sequence: Synthetic peptide
  Seed: AASSSTLVSIFQSS (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXS

SEQ ID NO: 255691 - protein, 14 aa, Artificial Sequence
  Description of Artificial Sequence: Synthetic peptide
  Seed: AASSSTLVSIFQSS (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSX

SEQ ID NO: 255692 - protein, 15 aa, Artificial Sequence
  Description of Artificial Sequence: Synthetic peptide
  Seed: AASSSTLVSIFQSSP (MAGC1_HUMAN)
  Core: SSTLVSIFQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AASXSTXVXIFXSSP

SEQ ID NO: 255693 - protein, 15 aa, Artificial Sequence
  Description of Artificial Sequence: Synthetic peptide
  Seed: AASSSTLVSIFQSSP (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSP

SEQ ID NO: 255694 - protein, 15 aa, Artificial Sequence
  Description of Artificial Sequence: Synthetic peptide
  Seed: AASSSTLVSIFQSSP (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXP

SEQ ID NO: 255695 - protein, 16 aa, Artificial Sequence
  Description of Artificial Sequence: Synthetic peptide
  Seed: AASSSTLVSIFQSSPE (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPE

SEQ ID NO: 255696 - protein, 16 aa, Artificial Sequence
  Description of Artificial Sequence: Synthetic peptide
  Seed: AASSSTLVSIFQSSPE (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPE

SEQ ID NO: 255697 - protein, 17 aa, Artificial Sequence
  Description of Artificial Sequence: Synthetic peptide
  Seed: AASSSTLVSIFQSSPES (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPES

SEQ ID NO: 255698 - protein, 17 aa, Artificial Sequence
  Description of Artificial Sequence: Synthetic peptide
  Seed: AASSSTLVSIFQSSPES (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPES

SEQ ID NO: 255699 - protein, 17 aa, Artificial Sequence
  Description of Artificial Sequence: Synthetic peptide
  Seed: AASSSTLVSIFQSSPES (MAGC1_HUMAN)
  Core: LVSIFQSSP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTXVSXFXSSXES

SEQ ID NO: 255700 - protein, 17 aa, Artificial Sequence
  Description of Artificial Sequence: Synthetic peptide
  Seed: AASSSTLVSIFQSSPES (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXS

SEQ ID NO: 255701 - protein, 18 aa, Artificial Sequence
  Description of Artificial Sequence: Synthetic peptide
  Seed: AASSSTLVSIFQSSPEST (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPEST

SEQ ID NO: 255702 - protein, 18 aa, Artificial Sequence
  Description of Artificial Sequence: Synthetic peptide
  Seed: AASSSTLVSIFQSSPEST (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPEST

SEQ ID NO: 255703 - protein, 18 aa, Artificial Sequence
  Description of Artificial Sequence: Synthetic peptide
  Seed: AASSSTLVSIFQSSPEST (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXST

SEQ ID NO: 255704 - protein, 18 aa, Artificial Sequence
  Description of Artificial Sequence: Synthetic peptide
  Seed: AASSSTLVSIFQSSPEST (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESX

SEQ ID NO: 255705 - protein, 19 aa, Artificial Sequence
  Description of Artificial Sequence: Synthetic peptide
  Seed: AASSSTLVSIFQSSPESTQ (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQ

SEQ ID NO: 255706 - protein, 19 aa, Artificial Sequence
  Description of Artificial Sequence: Synthetic peptide
  Seed: AASSSTLVSIFQSSPESTQ (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQ

SEQ ID NO: 255707 - protein, 19 aa, Artificial Sequence
  Description of Artificial Sequence: Synthetic peptide
  Seed: AASSSTLVSIFQSSPESTQ (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQ

SEQ ID NO: 255708 - protein, 19 aa, Artificial Sequence
  Description of Artificial Sequence: Synthetic peptide
  Seed: AASSSTLVSIFQSSPESTQ (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQ

SEQ ID NO: 255709 - protein, 20 aa, Artificial Sequence
  Description of Artificial Sequence: Synthetic peptide
  Seed: AASSSTLVSIFQSSPESTQS (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQS

SEQ ID NO: 255710 - protein, 20 aa, Artificial Sequence
  Description of Artificial Sequence: Synthetic peptide
  Seed: AASSSTLVSIFQSSPESTQS (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQS

SEQ ID NO: 255711 - protein, 20 aa, Artificial Sequence
  Description of Artificial Sequence: Synthetic peptide
  Seed: AASSSTLVSIFQSSPESTQS (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQS

SEQ ID NO: 255712 - protein, 20 aa, Artificial Sequence
  Description of Artificial Sequence: Synthetic peptide
  Seed: AASSSTLVSIFQSSPESTQS (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQS

SEQ ID NO: 255713 - protein, 21 aa, Artificial Sequence
  Description of Artificial Sequence: Synthetic peptide
  Seed: AASSSTLVSIFQSSPESTQSP (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQSP

SEQ ID NO: 255714 - protein, 21 aa, Artificial Sequence
  Description of Artificial Sequence: Synthetic peptide
  Seed: AASSSTLVSIFQSSPESTQSP (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQSP

SEQ ID NO: 255715 - protein, 21 aa, Artificial Sequence
  Description of Artificial Sequence: Synthetic peptide
  Seed: AASSSTLVSIFQSSPESTQSP (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQSP

SEQ ID NO: 255716 - protein, 21 aa, Artificial Sequence
  Description of Artificial Sequence: Synthetic peptide
  Seed: AASSSTLVSIFQSSPESTQSP (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQSP

SEQ ID NO: 255717 - protein, 22 aa, Artificial Sequence
  Description of Artificial Sequence: Synthetic peptide
  Seed: AASSSTLVSIFQSSPESTQSPF (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQSPF

SEQ ID NO: 255718 - protein, 22 aa, Artificial Sequence
  Description of Artificial Sequence: Synthetic peptide
  Seed: AASSSTLVSIFQSSPESTQSPF (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQSPF

SEQ ID NO: 255719 - protein, 22 aa, Artificial Sequence
  Description of Artificial Sequence: Synthetic peptide
  Seed: AASSSTLVSIFQSSPESTQSPF (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQSPF

SEQ ID NO: 255720 - protein, 22 aa, Artificial Sequence
  Description of Artificial Sequence: Synthetic peptide
  Seed: AASSSTLVSIFQSSPESTQSPF (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQSPF

SEQ ID NO: 255721 - protein, 22 aa, Artificial Sequence
  Description of Artificial Sequence: Synthetic peptide
  Seed: AASSSTLVSIFQSSPESTQSPF (MAGC1_HUMAN)
  Core: FQSSPESTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSIXQSXPXSTXSPF

SEQ ID NO: 255722 - protein, 23 aa, Artificial Sequence
  Description of Artificial Sequence: Synthetic peptide
  Seed: AASSSTLVSIFQSSPESTQSPFE (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQSPFE

SEQ ID NO: 255723 - protein, 23 aa, Artificial Sequence
  Description of Artificial Sequence: Synthetic peptide
  Seed: AASSSTLVSIFQSSPESTQSPFE (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQSPFE

SEQ ID NO: 255724 - protein, 23 aa, Artificial Sequence
  Description of Artificial Sequence: Synthetic peptide
  Seed: AASSSTLVSIFQSSPESTQSPFE (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQSPFE

SEQ ID NO: 255725 - protein, 23 aa, Artificial Sequence
  Description of Artificial Sequence: Synthetic peptide
  Seed: AASSSTLVSIFQSSPESTQSPFE (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQSPFE

SEQ ID NO: 255726 - protein, 23 aa, Artificial Sequence
  Description of Artificial Sequence: Synthetic peptide
  Seed: AASSSTLVSIFQSSPESTQSPFE (MAGC1_HUMAN)
  Core: FQSSPESTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSIXQSXPXSTXSPFE

SEQ ID NO: 255727 - protein, 24 aa, Artificial Sequence
  Description of Artificial Sequence: Synthetic peptide
  Seed: AASSSTLVSIFQSSPESTQSPFEG (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQSPFEG

SEQ ID NO: 255728 - protein, 24 aa, Artificial Sequence
  Description of Artificial Sequence: Synthetic peptide
  Seed: AASSSTLVSIFQSSPESTQSPFEG (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQSPFEG

SEQ ID NO: 255729 - protein, 24 aa, Artificial Sequence
  Description of Artificial Sequence: Synthetic peptide
  Seed: AASSSTLVSIFQSSPESTQSPFEG (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQSPFEG

SEQ ID NO: 255730 - protein, 24 aa, Artificial Sequence
  Description of Artificial Sequence: Synthetic peptide
  Seed: AASSSTLVSIFQSSPESTQSPFEG (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQSPFEG

SEQ ID NO: 255731 - protein, 24 aa, Artificial Sequence
  Description of Artificial Sequence: Synthetic peptide
  Seed: AASSSTLVSIFQSSPESTQSPFEG (MAGC1_HUMAN)
  Core: FQSSPESTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSIXQSXPXSTXSPFEG

SEQ ID NO: 255732 - protein, 25 aa, Artificial Sequence
  Description of Artificial Sequence: Synthetic peptide
  Seed: AASSSTLVSIFQSSPESTQSPFEGF (MAGC1_HUMAN)
  Core: STLVSIFQS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AASSXTLXSXFQXSPESTQSPFEGF

SEQ ID NO: 255733 - protein, 25 aa, Artificial Sequence
  Description of Artificial Sequence: Synthetic peptide
  Seed: AASSSTLVSIFQSSPESTQSPFEGF (MAGC1_HUMAN)
  Core: TLVSIFQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AASSSXLVXIXQSXPESTQSPFEGF

SEQ ID NO: 255734 - protein, 25 aa, Artificial Sequence
  Description of Artificial Sequence: Synthetic peptide
  Seed: AASSSTLVSIFQSSPESTQSPFEGF (MAGC1_HUMAN)
  Core: VSIFQSSPE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLXSIXQXSPXSTQSPFEGF

SEQ ID NO: 255735 - protein, 25 aa, Artificial Sequence
  Description of Artificial Sequence: Synthetic peptide
  Seed: AASSSTLVSIFQSSPESTQSPFEGF (MAGC1_HUMAN)
  Core: IFQSSPEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSXFQXSXESXQSPFEGF

SEQ ID NO: 255736 - protein, 25 aa, Artificial Sequence
  Description of Artificial Sequence: Synthetic peptide
  Seed: AASSSTLVSIFQSSPESTQSPFEGF (MAGC1_HUMAN)
  Core: FQSSPESTQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSIXQSXPXSTXSPFEGF

SEQ ID NO: 255737 - protein, 25 aa, Artificial Sequence
  Description of Artificial Sequence: Synthetic peptide
  Seed: AASSSTLVSIFQSSPESTQSPFEGF (MAGC1_HUMAN)
  Core: PESTQSPFE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AASSSTLVSIFQSSXESXQXPFXGF

SEQ ID NO: 255738 - protein, 13 aa, Artificial Sequence
  Description of Artificial Sequence: Synthetic peptide
  Seed: AEMLTNVISRYTG (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTG

SEQ ID NO: 255739 - protein, 13 aa, Artificial Sequence
  Description of Artificial Sequence: Synthetic peptide
  Seed: AEMLTNVISRYTG (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXG

SEQ ID NO: 255740 - protein, 14 aa, Artificial Sequence
  Description of Artificial Sequence: Synthetic peptide
  Seed: AEMLTNVISRYTGY (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGY

SEQ ID NO: 255741 - protein, 14 aa, Artificial Sequence
  Description of Artificial Sequence: Synthetic peptide
  Seed: AEMLTNVISRYTGY (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGY

SEQ ID NO: 255742 - protein, 15 aa, Artificial Sequence
  Description of Artificial Sequence: Synthetic peptide
  Seed: AEMLTNVISRYTGYF (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYF

SEQ ID NO: 255743 - protein, 15 aa, Artificial Sequence
  Description of Artificial Sequence: Synthetic peptide
  Seed: AEMLTNVISRYTGYF (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYF

SEQ ID NO: 255744 - protein, 15 aa, Artificial Sequence
  Description of Artificial Sequence: Synthetic peptide
  Seed: AEMLTNVISRYTGYF (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYF

SEQ ID NO: 255745 - protein, 16 aa, Artificial Sequence
  Description of Artificial Sequence: Synthetic peptide
  Seed: AEMLTNVISRYTGYFP (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFP

SEQ ID NO: 255746 - protein, 16 aa, Artificial Sequence
  Description of Artificial Sequence: Synthetic peptide
  Seed: AEMLTNVISRYTGYFP (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFP

SEQ ID NO: 255747 - protein, 16 aa, Artificial Sequence
  Description of Artificial Sequence: Synthetic peptide
  Seed: AEMLTNVISRYTGYFP (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFP

SEQ ID NO: 255748 - protein, 16 aa, Artificial Sequence
  Description of Artificial Sequence: Synthetic peptide
  Seed: AEMLTNVISRYTGYFP (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXP

SEQ ID NO: 255749 - protein, 16 aa, Artificial Sequence
  Description of Artificial Sequence: Synthetic peptide
  Seed: AEMLTNVISRYTGYFP (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFX

SEQ ID NO: 255750 - protein, 17 aa, Artificial Sequence
  Description of Artificial Sequence: Synthetic peptide
  Seed: AEMLTNVISRYTGYFPV (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPV

SEQ ID NO: 255751 - protein, 17 aa, Artificial Sequence
  Description of Artificial Sequence: Synthetic peptide
  Seed: AEMLTNVISRYTGYFPV (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPV

SEQ ID NO: 255752 - protein, 17 aa, Artificial Sequence
  Description of Artificial Sequence: Synthetic peptide
  Seed: AEMLTNVISRYTGYFPV (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPV

SEQ ID NO: 255753 - protein, 17 aa, Artificial Sequence
  Description of Artificial Sequence: Synthetic peptide
  Seed: AEMLTNVISRYTGYFPV (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPV

SEQ ID NO: 255754 - protein, 17 aa, Artificial Sequence
  Description of Artificial Sequence: Synthetic peptide
  Seed: AEMLTNVISRYTGYFPV (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXV

SEQ ID NO: 255755 - protein, 17 aa, Artificial Sequence
  Description of Artificial Sequence: Synthetic peptide
  Seed: AEMLTNVISRYTGYFPV (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPX

SEQ ID NO: 255756 - protein, 18 aa, Artificial Sequence
  Description of Artificial Sequence: Synthetic peptide
  Seed: AEMLTNVISRYTGYFPVI (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVI

SEQ ID NO: 255757 - protein, 18 aa, Artificial Sequence
  Description of Artificial Sequence: Synthetic peptide
  Seed: AEMLTNVISRYTGYFPVI (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVI

SEQ ID NO: 255758 - protein, 18 aa, Artificial Sequence
  Description of Artificial Sequence: Synthetic peptide
  Seed: AEMLTNVISRYTGYFPVI (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVI

SEQ ID NO: 255759 - protein, 18 aa, Artificial Sequence
  Description of Artificial Sequence: Synthetic peptide
  Seed: AEMLTNVISRYTGYFPVI (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPXI

SEQ ID NO: 255760 - protein, 19 aa, Artificial Sequence
  Description of Artificial Sequence: Synthetic peptide
  Seed: AEMLTNVISRYTGYFPVIF (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIF

SEQ ID NO: 255761 - protein, 19 aa, Artificial Sequence
  Description of Artificial Sequence: Synthetic peptide
  Seed: AEMLTNVISRYTGYFPVIF (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPVIF

SEQ ID NO: 255762 - protein, 19 aa, Artificial Sequence
  Description of Artificial Sequence: Synthetic peptide
  Seed: AEMLTNVISRYTGYFPVIF (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPVIF

SEQ ID NO: 255763 - protein, 19 aa, Artificial Sequence
  Description of Artificial Sequence: Synthetic peptide
  Seed: AEMLTNVISRYTGYFPVIF (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVIF

SEQ ID NO: 255764 - protein, 19 aa, Artificial Sequence
  Description of Artificial Sequence: Synthetic peptide
  Seed: AEMLTNVISRYTGYFPVIF (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIF

SEQ ID NO: 255765 - protein, 19 aa, Artificial Sequence
  Description of Artificial Sequence: Synthetic peptide
  Seed: AEMLTNVISRYTGYFPVIF (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPXIF

SEQ ID NO: 255766 - protein, 19 aa, Artificial Sequence
  Description of Artificial Sequence: Synthetic peptide
  Seed: AEMLTNVISRYTGYFPVIF (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXF

SEQ ID NO: 255767 - protein, 20 aa, Artificial Sequence
  Description of Artificial Sequence: Synthetic peptide
  Seed: AEMLTNVISRYTGYFPVIFR (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFR

SEQ ID NO: 255768 - protein, 20 aa, Artificial Sequence
  Description of Artificial Sequence: Synthetic peptide
  Seed: AEMLTNVISRYTGYFPVIFR (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPVIFR

SEQ ID NO: 255769 - protein, 20 aa, Artificial Sequence
  Description of Artificial Sequence: Synthetic peptide
  Seed: AEMLTNVISRYTGYFPVIFR (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPVIFR

SEQ ID NO: 255770 - protein, 20 aa, Artificial Sequence
  Description of Artificial Sequence: Synthetic peptide
  Seed: AEMLTNVISRYTGYFPVIFR (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVIFR

SEQ ID NO: 255771 - protein, 20 aa, Artificial Sequence
  Description of Artificial Sequence: Synthetic peptide
  Seed: AEMLTNVISRYTGYFPVIFR (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFR

SEQ ID NO: 255772 - protein, 20 aa, Artificial Sequence
  Description of Artificial Sequence: Synthetic peptide
  Seed: AEMLTNVISRYTGYFPVIFR (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPXIFR

SEQ ID NO: 255773 - protein, 20 aa, Artificial Sequence
  Description of Artificial Sequence: Synthetic peptide
  Seed: AEMLTNVISRYTGYFPVIFR (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFR

SEQ ID NO: 255774 - protein, 20 aa, Artificial Sequence
  Description of Artificial Sequence: Synthetic peptide
  Seed: AEMLTNVISRYTGYFPVIFR (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXR

SEQ ID NO: 255775 - protein, 21 aa, Artificial Sequence
  Description of Artificial Sequence: Synthetic peptide
  Seed: AEMLTNVISRYTGYFPVIFRK (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFRK

SEQ ID NO: 255776 - protein, 21 aa, Artificial Sequence
  Description of Artificial Sequence: Synthetic peptide
  Seed: AEMLTNVISRYTGYFPVIFRK (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPVIFRK

SEQ ID NO: 255777 - protein, 21 aa, Artificial Sequence
  Description of Artificial Sequence: Synthetic peptide
  Seed: AEMLTNVISRYTGYFPVIFRK (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPVIFRK

SEQ ID NO: 255778 - protein, 21 aa, Artificial Sequence
  Description of Artificial Sequence: Synthetic peptide
  Seed: AEMLTNVISRYTGYFPVIFRK (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVIFRK

SEQ ID NO: 255779 - protein, 21 aa, Artificial Sequence
  Description of Artificial Sequence: Synthetic peptide
  Seed: AEMLTNVISRYTGYFPVIFRK (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFRK

SEQ ID NO: 255780 - protein, 21 aa, Artificial Sequence
  Description of Artificial Sequence: Synthetic peptide
  Seed: AEMLTNVISRYTGYFPVIFRK (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPXIFRK

SEQ ID NO: 255781 - protein, 21 aa, Artificial Sequence
  Description of Artificial Sequence: Synthetic peptide
  Seed: AEMLTNVISRYTGYFPVIFRK (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFRK

SEQ ID NO: 255782 - protein, 21 aa, Artificial Sequence
  Description of Artificial Sequence: Synthetic peptide
  Seed: AEMLTNVISRYTGYFPVIFRK (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXRK

SEQ ID NO: 255783 - protein, 22 aa, Artificial Sequence
  Description of Artificial Sequence: Synthetic peptide
  Seed: AEMLTNVISRYTGYFPVIFRKA (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFRKA

SEQ ID NO: 255784 - protein, 22 aa, Artificial Sequence
  Description of Artificial Sequence: Synthetic peptide
  Seed: AEMLTNVISRYTGYFPVIFRKA (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPVIFRKA

SEQ ID NO: 255785 - protein, 22 aa, Artificial Sequence
  Description of Artificial Sequence: Synthetic peptide
  Seed: AEMLTNVISRYTGYFPVIFRKA (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPVIFRKA

SEQ ID NO: 255786 - protein, 22 aa, Artificial Sequence
  Description of Artificial Sequence: Synthetic peptide
  Seed: AEMLTNVISRYTGYFPVIFRKA (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVIFRKA

SEQ ID NO: 255787 - protein, 22 aa, Artificial Sequence
  Description of Artificial Sequence: Synthetic peptide
  Seed: AEMLTNVISRYTGYFPVIFRKA (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFRKA

SEQ ID NO: 255788 - protein, 22 aa, Artificial Sequence
  Description of Artificial Sequence: Synthetic peptide
  Seed: AEMLTNVISRYTGYFPVIFRKA (MAGC1_HUMAN)
  Core: SRYTGYFPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVIXRYXGXFPXIFRKA

SEQ ID NO: 255789 - protein, 22 aa, Artificial Sequence
  Description of Artificial Sequence: Synthetic peptide
  Seed: AEMLTNVISRYTGYFPVIFRKA (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFRKA

SEQ ID NO: 255790 - protein, 22 aa, Artificial Sequence
  Description of Artificial Sequence: Synthetic peptide
  Seed: AEMLTNVISRYTGYFPVIFRKA (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXRKA

SEQ ID NO: 255791 - protein, 22 aa, Artificial Sequence
  Description of Artificial Sequence: Synthetic peptide
  Seed: AEMLTNVISRYTGYFPVIFRKA (MAGC1_HUMAN)
  Core: YFPVIFRKA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYTGXFPXIXRKX

SEQ ID NO: 255792 - protein, 23 aa, Artificial Sequence
  Description of Artificial Sequence: Synthetic peptide
  Seed: AEMLTNVISRYTGYFPVIFRKAR (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFRKAR

SEQ ID NO: 255793 - protein, 23 aa, Artificial Sequence
  Description of Artificial Sequence: Synthetic peptide
  Seed: AEMLTNVISRYTGYFPVIFRKAR (MAGC1_HUMAN)
  Core: LTNVISRYT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AEMXTNXIXRYXGYFPVIFRKAR

SEQ ID NO: 255794 - protein, 23 aa, Artificial Sequence
  Description of Artificial Sequence: Synthetic peptide
  Seed: AEMLTNVISRYTGYFPVIFRKAR (MAGC1_HUMAN)
  Core: TNVISRYTG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AEMLXNVXSXYTXYFPVIFRKAR

SEQ ID NO: 255795 - protein, 23 aa, Artificial Sequence
  Description of Artificial Sequence: Synthetic peptide
  Seed: AEMLTNVISRYTGYFPVIFRKAR (MAGC1_HUMAN)
  Core: VISRYTGYF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNXISXYXGYXPVIFRKAR

SEQ ID NO: 255796 - protein, 23 aa, Artificial Sequence
  Description of Artificial Sequence: Synthetic peptide
  Seed: AEMLTNVISRYTGYFPVIFRKAR (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFRKAR

SEQ ID NO: 255797 - protein, 23 aa, Artificial Sequence
  Description of Artificial Sequence: Synthetic peptide
  Seed: AEMLTNVISRYTGYFPVIFRKAR (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFRKAR

SEQ ID NO: 255798 - protein, 23 aa, Artificial Sequence
  Description of Artificial Sequence: Synthetic peptide
  Seed: AEMLTNVISRYTGYFPVIFRKAR (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXRKAR

SEQ ID NO: 255799 - protein, 23 aa, Artificial Sequence
  Description of Artificial Sequence: Synthetic peptide
  Seed: AEMLTNVISRYTGYFPVIFRKAR (MAGC1_HUMAN)
  Core: TGYFPVIFR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYXGYXPXIFXKAR

SEQ ID NO: 255800 - protein, 23 aa, Artificial Sequence
  Description of Artificial Sequence: Synthetic peptide
  Seed: AEMLTNVISRYTGYFPVIFRKAR (MAGC1_HUMAN)
  Core: YFPVIFRKA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYTGXFPXIXRKXR

SEQ ID NO: 255801 - protein, 24 aa, Artificial Sequence
  Description of Artificial Sequence: Synthetic peptide
  Seed: AEMLTNVISRYTGYFPVIFRKARE (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFRKARE

SEQ ID NO: 255802 - protein, 24 aa, Artificial Sequence
  Description of Artificial Sequence: Synthetic peptide
  Seed: AEMLTNVISRYTGYFPVIFRKARE (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFRKARE

SEQ ID NO: 255803 - protein, 24 aa, Artificial Sequence
  Description of Artificial Sequence: Synthetic peptide
  Seed: AEMLTNVISRYTGYFPVIFRKARE (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFRKARE

SEQ ID NO: 255804 - protein, 24 aa, Artificial Sequence
  Description of Artificial Sequence: Synthetic peptide
  Seed: AEMLTNVISRYTGYFPVIFRKARE (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXRKARE

SEQ ID NO: 255805 - protein, 24 aa, Artificial Sequence
  Description of Artificial Sequence: Synthetic peptide
  Seed: AEMLTNVISRYTGYFPVIFRKARE (MAGC1_HUMAN)
  Core: TGYFPVIFR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYXGYXPXIFXKARE

SEQ ID NO: 255806 - protein, 24 aa, Artificial Sequence
  Description of Artificial Sequence: Synthetic peptide
  Seed: AEMLTNVISRYTGYFPVIFRKARE (MAGC1_HUMAN)
  Core: YFPVIFRKA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYTGXFPXIXRKXRE

SEQ ID NO: 255807 - protein, 25 aa, Artificial Sequence
  Description of Artificial Sequence: Synthetic peptide
  Seed: AEMLTNVISRYTGYFPVIFRKAREF (MAGC1_HUMAN)
  Core: MLTNVISRY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AEXLTXVXSRXTGYFPVIFRKAREF

SEQ ID NO: 255808 - protein, 25 aa, Artificial Sequence
  Description of Artificial Sequence: Synthetic peptide
  Seed: AEMLTNVISRYTGYFPVIFRKAREF (MAGC1_HUMAN)
  Core: ISRYTGYFP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVXSRXTXYFXVIFRKAREF

SEQ ID NO: 255809 - protein, 25 aa, Artificial Sequence
  Description of Artificial Sequence: Synthetic peptide
  Seed: AEMLTNVISRYTGYFPVIFRKAREF (MAGC1_HUMAN)
  Core: RYTGYFPVI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISXYTXYXPVXFRKAREF

SEQ ID NO: 255810 - protein, 25 aa, Artificial Sequence
  Description of Artificial Sequence: Synthetic peptide
  Seed: AEMLTNVISRYTGYFPVIFRKAREF (MAGC1_HUMAN)
  Core: YTGYFPVIF
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRXTGXFXVIXRKAREF

SEQ ID NO: 255811 - protein, 25 aa, Artificial Sequence
  Description of Artificial Sequence: Synthetic peptide
  Seed: AEMLTNVISRYTGYFPVIFRKAREF (MAGC1_HUMAN)
  Core: TGYFPVIFR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYXGYXPXIFXKAREF

SEQ ID NO: 255812 - protein, 25 aa, Artificial Sequence
  Description of Artificial Sequence: Synthetic peptide
  Seed: AEMLTNVISRYTGYFPVIFRKAREF (MAGC1_HUMAN)
  Core: YFPVIFRKA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYTGXFPXIXRKXREF

SEQ ID NO: 255813 - protein, 25 aa, Artificial Sequence
  Description of Artificial Sequence: Synthetic peptide
  Seed: AEMLTNVISRYTGYFPVIFRKAREF (MAGC1_HUMAN)
  Core: PVIFRKARE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AEMLTNVISRYTGYFXVIXRXARXF

SEQ ID NO: 255814 - protein, 15 aa, Artificial Sequence
  Description of Artificial Sequence: Synthetic peptide
  Seed: AFEGFPQSPLQIPVS (MAGC1_HUMAN)
  Core: FEGFPQSPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXEGXPXSPXQIPVS

SEQ ID NO: 255815 - protein, 15 aa, Artificial Sequence
  Description of Artificial Sequence: Synthetic peptide
  Seed: AFEGFPQSPLQIPVS (MAGC1_HUMAN)
  Core: GFPQSPLQI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFEXFPXSXLQXPVS

SEQ ID NO: 255816 - protein, 16 aa, Artificial Sequence
  Description of Artificial Sequence: Synthetic peptide
  Seed: AFEGFPQSPLQIPVSS (MAGC1_HUMAN)
  Core: FEGFPQSPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXEGXPXSPXQIPVSS

SEQ ID NO: 255817 - protein, 17 aa, Artificial Sequence
  Description of Artificial Sequence: Synthetic peptide
  Seed: AFEGFPQSPLQIPVSSS (MAGC1_HUMAN)
  Core: FEGFPQSPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXEGXPXSPXQIPVSSS

SEQ ID NO: 255818 - protein, 19 aa, Artificial Sequence
  Description of Artificial Sequence: Synthetic peptide
  Seed: AFEGFPQSPLQIPVSSSFS (MAGC1_HUMAN)
  Core: FEGFPQSPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXEGXPXSPXQIPVSSSFS

SEQ ID NO: 255819 - protein, 20 aa, Artificial Sequence
  Description of Artificial Sequence: Synthetic peptide
  Seed: AFEGFPQSPLQIPVSSSFSY (MAGC1_HUMAN)
  Core: FEGFPQSPL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXEGXPXSPXQIPVSSSFSY

SEQ ID NO: 255820 - protein, 20 aa, Artificial Sequence
  Description of Artificial Sequence: Synthetic peptide
  Seed: AFEGFPQSPLQIPVSSSFSY (MAGC1_HUMAN)
  Core: FPQSPLQIP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AFEGXPQXPXQIXVSSSFSY

SEQ ID NO: 255821 - protein, 20 aa, Artificial Sequence
  Description of Artificial Sequence: Synthetic peptide
  Seed: AFEGFPQSPLQIPVSSSFSY (MAGC1_HUMAN)
  Core: QSPLQIPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPXSPXQXPVXSSFSY

SEQ ID NO: 255822 - protein, 20 aa, Artificial Sequence
  Description of Artificial Sequence: Synthetic peptide
  Seed: AFEGFPQSPLQIPVSSSFSY (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSY

SEQ ID NO: 255823 - protein, 20 aa, Artificial Sequence
  Description of Artificial Sequence: Synthetic peptide
  Seed: AFEGFPQSPLQIPVSSSFSY (MAGC1_HUMAN)
  Core: LQIPVSSSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPXQIXVXSSXSY

SEQ ID NO: 255824 - protein, 21 aa, Artificial Sequence
  Description of Artificial Sequence: Synthetic peptide
  Seed: AFEGFPQSPLQIPVSSSFSYT (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSYT

SEQ ID NO: 255825 - protein, 22 aa, Artificial Sequence
  Description of Artificial Sequence: Synthetic peptide
  Seed: AFEGFPQSPLQIPVSSSFSYTL (MAGC1_HUMAN)
  Core: QSPLQIPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPXSPXQXPVXSSFSYTL

SEQ ID NO: 255826 - protein, 22 aa, Artificial Sequence
  Description of Artificial Sequence: Synthetic peptide
  Seed: AFEGFPQSPLQIPVSSSFSYTL (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSYTL

SEQ ID NO: 255827 - protein, 22 aa, Artificial Sequence
  Description of Artificial Sequence: Synthetic peptide
  Seed: AFEGFPQSPLQIPVSSSFSYTL (MAGC1_HUMAN)
  Core: LQIPVSSSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPXQIXVXSSXSYTL

SEQ ID NO: 255828 - protein, 22 aa, Artificial Sequence
  Description of Artificial Sequence: Synthetic peptide
  Seed: AFEGFPQSPLQIPVSSSFSYTL (MAGC1_HUMAN)
  Core: PVSSSFSYT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIXVSXSXSYXL

SEQ ID NO: 255829 - protein, 23 aa, Artificial Sequence
  Description of Artificial Sequence: Synthetic peptide
  Seed: AFEGFPQSPLQIPVSSSFSYTLL (MAGC1_HUMAN)
  Core: GFPQSPLQI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFEXFPXSXLQXPVSSSFSYTLL

SEQ ID NO: 255830 - protein, 23 aa, Artificial Sequence
  Description of Artificial Sequence: Synthetic peptide
  Seed: AFEGFPQSPLQIPVSSSFSYTLL (MAGC1_HUMAN)
  Core: QSPLQIPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPXSPXQXPVXSSFSYTLL

SEQ ID NO: 255831 - protein, 23 aa, Artificial Sequence
  Description of Artificial Sequence: Synthetic peptide
  Seed: AFEGFPQSPLQIPVSSSFSYTLL (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSYTLL

SEQ ID NO: 255832 - protein, 23 aa, Artificial Sequence
  Description of Artificial Sequence: Synthetic peptide
  Seed: AFEGFPQSPLQIPVSSSFSYTLL (MAGC1_HUMAN)
  Core: LQIPVSSSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPXQIXVXSSXSYTLL

SEQ ID NO: 255833 - protein, 23 aa, Artificial Sequence
  Description of Artificial Sequence: Synthetic peptide
  Seed: AFEGFPQSPLQIPVSSSFSYTLL (MAGC1_HUMAN)
  Core: PVSSSFSYT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIXVSXSXSYXLL

SEQ ID NO: 255834 - protein, 23 aa, Artificial Sequence
  Description of Artificial Sequence: Synthetic peptide
  Seed: AFEGFPQSPLQIPVSSSFSYTLL (MAGC1_HUMAN)
  Core: VSSSFSYTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIPXSSXFXYTXL

SEQ ID NO: 255835 - protein, 24 aa, Artificial Sequence
  Description of Artificial Sequence: Synthetic peptide
  Seed: AFEGFPQSPLQIPVSSSFSYTLLS (MAGC1_HUMAN)
  Core: GFPQSPLQI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AFEXFPXSXLQXPVSSSFSYTLLS

SEQ ID NO: 255836 - protein, 24 aa, Artificial Sequence
  Description of Artificial Sequence: Synthetic peptide
  Seed: AFEGFPQSPLQIPVSSSFSYTLLS (MAGC1_HUMAN)
  Core: QSPLQIPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPXSPXQXPVXSSFSYTLLS

SEQ ID NO: 255837 - protein, 24 aa, Artificial Sequence
  Description of Artificial Sequence: Synthetic peptide
  Seed: AFEGFPQSPLQIPVSSSFSYTLLS (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSYTLLS

SEQ ID NO: 255838 - protein, 24 aa, Artificial Sequence
  Description of Artificial Sequence: Synthetic peptide
  Seed: AFEGFPQSPLQIPVSSSFSYTLLS (MAGC1_HUMAN)
  Core: LQIPVSSSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPXQIXVXSSXSYTLLS

SEQ ID NO: 255839 - protein, 24 aa, Artificial Sequence
  Description of Artificial Sequence: Synthetic peptide
  Seed: AFEGFPQSPLQIPVSSSFSYTLLS (MAGC1_HUMAN)
  Core: QIPVSSSFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLXIPXSXSFXYTLLS

SEQ ID NO: 255840 - protein, 24 aa, Artificial Sequence
  Description of Artificial Sequence: Synthetic peptide
  Seed: AFEGFPQSPLQIPVSSSFSYTLLS (MAGC1_HUMAN)
  Core: PVSSSFSYT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIXVSXSXSYXLLS

SEQ ID NO: 255841 - protein, 24 aa, Artificial Sequence
  Description of Artificial Sequence: Synthetic peptide
  Seed: AFEGFPQSPLQIPVSSSFSYTLLS (MAGC1_HUMAN)
  Core: VSSSFSYTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIPXSSXFXYTXLS

SEQ ID NO: 255842 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: QSPLQIPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPXSPXQXPVXSSFSYTLLSL

SEQ ID NO: 255843 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: PLQIPVSSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSXLQXPXSSXFSYTLLSL

SEQ ID NO: 255844 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: LQIPVSSSF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPXQIXVXSSXSYTLLSL

SEQ ID NO: 255845 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: QIPVSSSFS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLXIPXSXSFXYTLLSL

SEQ ID NO: 255846 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: PVSSSFSYT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIXVSXSXSYXLLSL

SEQ ID NO: 255847 - protein, 25 aa, Artificial Sequence
  Description of Artificial Sequence: Synthetic peptide
  Seed: AFEGFPQSPLQIPVSSSFSYTLLSL (MAGC1_HUMAN)
  Core: VSSSFSYTL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AFEGFPQSPLQIPXSSXFXYTXLSL

SEQ ID NO: 255848 - protein, 16 aa, Artificial Sequence
  Description of Artificial Sequence: Synthetic peptide
  Seed: AFGEPRELLTKVWVQE (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQX

SEQ ID NO: 255849 - protein, 17 aa, Artificial Sequence
  Description of Artificial Sequence: Synthetic peptide
  Seed: AFGEPRELLTKVWVQEH (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEH

SEQ ID NO: 255850 - protein, 17 aa, Artificial Sequence
  Description of Artificial Sequence: Synthetic peptide
  Seed: AFGEPRELLTKVWVQEH (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXH

SEQ ID NO: 255851 - protein, 18 aa, Artificial Sequence
  Description of Artificial Sequence: Synthetic peptide
  Seed: AFGEPRELLTKVWVQEHY (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHY

SEQ ID NO: 255852 - protein, 19 aa, Artificial Sequence
  Description of Artificial Sequence: Synthetic peptide
  Seed: AFGEPRELLTKVWVQEHYL (MAGC1_HUMAN)
  Core: RELLTKVWV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPXELXTXVWXQEHYL

SEQ ID NO: 255853 - protein, 19 aa, Artificial Sequence
  Description of Artificial Sequence: Synthetic peptide
  Seed: AFGEPRELLTKVWVQEHYL (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYL

SEQ ID NO: 255854 - protein, 19 aa, Artificial Sequence
  Description of Artificial Sequence: Synthetic peptide
  Seed: AFGEPRELLTKVWVQEHYL (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHYL

SEQ ID NO: 255855 - protein, 19 aa, Artificial Sequence
  Description of Artificial Sequence: Synthetic peptide
  Seed: AFGEPRELLTKVWVQEHYL (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYL

SEQ ID NO: 255856 - protein, 20 aa, Artificial Sequence
  Description of Artificial Sequence: Synthetic peptide
  Seed: AFGEPRELLTKVWVQEHYLE (MAGC1_HUMAN)
  Core: RELLTKVWV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPXELXTXVWXQEHYLE

SEQ ID NO: 255857 - protein, 20 aa, Artificial Sequence
  Description of Artificial Sequence: Synthetic peptide
  Seed: AFGEPRELLTKVWVQEHYLE (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYLE

SEQ ID NO: 255858 - protein, 20 aa, Artificial Sequence
  Description of Artificial Sequence: Synthetic peptide
  Seed: AFGEPRELLTKVWVQEHYLE (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHYLE

SEQ ID NO: 255859 - protein, 20 aa, Artificial Sequence
  Description of Artificial Sequence: Synthetic peptide
  Seed: AFGEPRELLTKVWVQEHYLE (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLE

SEQ ID NO: 255860 - protein, 20 aa, Artificial Sequence
  Description of Artificial Sequence: Synthetic peptide
  Seed: AFGEPRELLTKVWVQEHYLE (MAGC1_HUMAN)
  Core: KVWVQEHYL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTXVWXQXHYXE

SEQ ID NO: 255861 - protein, 21 aa, Artificial Sequence
  Description of Artificial Sequence: Synthetic peptide
  Seed: AFGEPRELLTKVWVQEHYLEY (MAGC1_HUMAN)
  Core: RELLTKVWV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPXELXTXVWXQEHYLEY

SEQ ID NO: 255862 - protein, 21 aa, Artificial Sequence
  Description of Artificial Sequence: Synthetic peptide
  Seed: AFGEPRELLTKVWVQEHYLEY (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYLEY

SEQ ID NO: 255863 - protein, 21 aa, Artificial Sequence
  Description of Artificial Sequence: Synthetic peptide
  Seed: AFGEPRELLTKVWVQEHYLEY (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHYLEY

SEQ ID NO: 255864 - protein, 21 aa, Artificial Sequence
  Description of Artificial Sequence: Synthetic peptide
  Seed: AFGEPRELLTKVWVQEHYLEY (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLEY

SEQ ID NO: 255865 - protein, 21 aa, Artificial Sequence
  Description of Artificial Sequence: Synthetic peptide
  Seed: AFGEPRELLTKVWVQEHYLEY (MAGC1_HUMAN)
  Core: WVQEHYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVXVQXHXLEX

SEQ ID NO: 255866 - protein, 22 aa, Artificial Sequence
  Description of Artificial Sequence: Synthetic peptide
  Seed: AFGEPRELLTKVWVQEHYLEYR (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYLEYR

SEQ ID NO: 255867 - protein, 22 aa, Artificial Sequence
  Description of Artificial Sequence: Synthetic peptide
  Seed: AFGEPRELLTKVWVQEHYLEYR (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHYLEYR

SEQ ID NO: 255868 - protein, 22 aa, Artificial Sequence
  Description of Artificial Sequence: Synthetic peptide
  Seed: AFGEPRELLTKVWVQEHYLEYR (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLEYR

SEQ ID NO: 255869 - protein, 22 aa, Artificial Sequence
  Description of Artificial Sequence: Synthetic peptide
  Seed: AFGEPRELLTKVWVQEHYLEYR (MAGC1_HUMAN)
  Core: KVWVQEHYL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTXVWXQXHYXEYR

SEQ ID NO: 255870 - protein, 22 aa, Artificial Sequence
  Description of Artificial Sequence: Synthetic peptide
  Seed: AFGEPRELLTKVWVQEHYLEYR (MAGC1_HUMAN)
  Core: VWVQEHYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKXWVXEXYLXYR

SEQ ID NO: 255871 - protein, 22 aa, Artificial Sequence
  Description of Artificial Sequence: Synthetic peptide
  Seed: AFGEPRELLTKVWVQEHYLEYR (MAGC1_HUMAN)
  Core: WVQEHYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVXVQXHXLEXR

SEQ ID NO: 255872 - protein, 23 aa, Artificial Sequence
  Description of Artificial Sequence: Synthetic peptide
  Seed: AFGEPRELLTKVWVQEHYLEYRE (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYLEYRE

SEQ ID NO: 255873 - protein, 23 aa, Artificial Sequence
  Description of Artificial Sequence: Synthetic peptide
  Seed: AFGEPRELLTKVWVQEHYLEYRE (MAGC1_HUMAN)
  Core: LLTKVWVQE
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPREXLTXVXVQXHYLEYRE

SEQ ID NO: 255874 - protein, 23 aa, Artificial Sequence
  Description of Artificial Sequence: Synthetic peptide
  Seed: AFGEPRELLTKVWVQEHYLEYRE (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLEYRE

SEQ ID NO: 255875 - protein, 23 aa, Artificial Sequence
  Description of Artificial Sequence: Synthetic peptide
  Seed: AFGEPRELLTKVWVQEHYLEYRE (MAGC1_HUMAN)
  Core: VWVQEHYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKXWVXEXYLXYRE

SEQ ID NO: 255876 - protein, 23 aa, Artificial Sequence
  Description of Artificial Sequence: Synthetic peptide
  Seed: AFGEPRELLTKVWVQEHYLEYRE (MAGC1_HUMAN)
  Core: WVQEHYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVXVQXHXLEXRE

SEQ ID NO: 255877 - protein, 24 aa, Artificial Sequence
  Description of Artificial Sequence: Synthetic peptide
  Seed: AFGEPRELLTKVWVQEHYLEYREV (MAGC1_HUMAN)
  Core: ELLTKVWVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRXLLXKXWVXEHYLEYREV

SEQ ID NO: 255878 - protein, 24 aa, Artificial Sequence
  Description of Artificial Sequence: Synthetic peptide
  Seed: AFGEPRELLTKVWVQEHYLEYREV (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLEYREV

SEQ ID NO: 255879 - protein, 24 aa, Artificial Sequence
  Description of Artificial Sequence: Synthetic peptide
  Seed: AFGEPRELLTKVWVQEHYLEYREV (MAGC1_HUMAN)
  Core: VWVQEHYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKXWVXEXYLXYREV

SEQ ID NO: 255880 - protein, 24 aa, Artificial Sequence
  Description of Artificial Sequence: Synthetic peptide
  Seed: AFGEPRELLTKVWVQEHYLEYREV (MAGC1_HUMAN)
  Core: WVQEHYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVXVQXHXLEXREV

SEQ ID NO: 255881 - protein, 24 aa, Artificial Sequence
  Description of Artificial Sequence: Synthetic peptide
  Seed: AFGEPRELLTKVWVQEHYLEYREV (MAGC1_HUMAN)
  Core: QEHYLEYRE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVWVXEHXLXYRXV

SEQ ID NO: 255882 - protein, 25 aa, Artificial Sequence
  Description of Artificial Sequence: Synthetic peptide
  Seed: AFGEPRELLTKVWVQEHYLEYREVP (MAGC1_HUMAN)
  Core: LTKVWVQEH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELXTKXWXQEXYLEYREVP

SEQ ID NO: 255883 - protein, 25 aa, Artificial Sequence
  Description of Artificial Sequence: Synthetic peptide
  Seed: AFGEPRELLTKVWVQEHYLEYREVP (MAGC1_HUMAN)
  Core: VWVQEHYLE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKXWVXEXYLXYREVP

SEQ ID NO: 255884 - protein, 25 aa, Artificial Sequence
  Description of Artificial Sequence: Synthetic peptide
  Seed: AFGEPRELLTKVWVQEHYLEYREVP (MAGC1_HUMAN)
  Core: WVQEHYLEY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVXVQXHXLEXREVP

SEQ ID NO: 255885 - protein, 25 aa, Artificial Sequence
  Description of Artificial Sequence: Synthetic peptide
  Seed: AFGEPRELLTKVWVQEHYLEYREVP (MAGC1_HUMAN)
  Core: QEHYLEYRE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AFGEPRELLTKVWVXEHXLXYRXVP

SEQ ID NO: 255886 - protein, 14 aa, Artificial Sequence
  Description of Artificial Sequence: Synthetic peptide
  Seed: AGREHFAFGEPREL (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREX

SEQ ID NO: 255887 - protein, 15 aa, Artificial Sequence
  Description of Artificial Sequence: Synthetic peptide
  Seed: AGREHFAFGEPRELL (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXL

SEQ ID NO: 255888 - protein, 16 aa, Artificial Sequence
  Description of Artificial Sequence: Synthetic peptide
  Seed: AGREHFAFGEPRELLT (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLT

SEQ ID NO: 255889 - protein, 17 aa, Artificial Sequence
  Description of Artificial Sequence: Synthetic peptide
  Seed: AGREHFAFGEPRELLTK (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTK

SEQ ID NO: 255890 - protein, 18 aa, Artificial Sequence
  Description of Artificial Sequence: Synthetic peptide
  Seed: AGREHFAFGEPRELLTKV (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKV

SEQ ID NO: 255891 - protein, 19 aa, Artificial Sequence
  Description of Artificial Sequence: Synthetic peptide
  Seed: AGREHFAFGEPRELLTKVW (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVW

SEQ ID NO: 255892 - protein, 20 aa, Artificial Sequence
  Description of Artificial Sequence: Synthetic peptide
  Seed: AGREHFAFGEPRELLTKVWV (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWV

SEQ ID NO: 255893 - protein, 21 aa, Artificial Sequence
  Description of Artificial Sequence: Synthetic peptide
  Seed: AGREHFAFGEPRELLTKVWVQ (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWVQ

SEQ ID NO: 255894 - protein, 22 aa, Artificial Sequence
  Description of Artificial Sequence: Synthetic peptide
  Seed: AGREHFAFGEPRELLTKVWVQE (MAGC1_HUMAN)
  Core: HFAFGEPRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGREXFAXGXPRXLLTKVWVQE

SEQ ID NO: 255895 - protein, 22 aa, Artificial Sequence
  Description of Artificial Sequence: Synthetic peptide
  Seed: AGREHFAFGEPRELLTKVWVQE (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWVQE

SEQ ID NO: 255896 - protein, 23 aa, Artificial Sequence
  Description of Artificial Sequence: Synthetic peptide
  Seed: AGREHFAFGEPRELLTKVWVQEH (MAGC1_HUMAN)
  Core: HFAFGEPRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGREXFAXGXPRXLLTKVWVQEH

SEQ ID NO: 255897 - protein, 23 aa, Artificial Sequence
  Description of Artificial Sequence: Synthetic peptide
  Seed: AGREHFAFGEPRELLTKVWVQEH (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWVQEH

SEQ ID NO: 255898 - protein, 23 aa, Artificial Sequence
  Description of Artificial Sequence: Synthetic peptide
  Seed: AGREHFAFGEPRELLTKVWVQEH (MAGC1_HUMAN)
  Core: RELLTKVWV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPXELXTXVWXQEH

SEQ ID NO: 255899 - protein, 23 aa, Artificial Sequence
  Description of Artificial Sequence: Synthetic peptide
  Seed: AGREHFAFGEPRELLTKVWVQEH (MAGC1_HUMAN)
  Core: LLTKVWVQE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPREXLTXVXVQXH

SEQ ID NO: 255900 - protein, 24 aa, Artificial Sequence
  Description of Artificial Sequence: Synthetic peptide
  Seed: AGREHFAFGEPRELLTKVWVQEHY (MAGC1_HUMAN)
  Core: HFAFGEPRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGREXFAXGXPRXLLTKVWVQEHY

SEQ ID NO: 255901 - protein, 24 aa, Artificial Sequence
  Description of Artificial Sequence: Synthetic peptide
  Seed: AGREHFAFGEPRELLTKVWVQEHY (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWVQEHY

SEQ ID NO: 255902 - protein, 24 aa, Artificial Sequence
  Description of Artificial Sequence: Synthetic peptide
  Seed: AGREHFAFGEPRELLTKVWVQEHY (MAGC1_HUMAN)
  Core: RELLTKVWV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPXELXTXVWXQEHY

SEQ ID NO: 255903 - protein, 24 aa, Artificial Sequence
  Description of Artificial Sequence: Synthetic peptide
  Seed: AGREHFAFGEPRELLTKVWVQEHY (MAGC1_HUMAN)
  Core: ELLTKVWVQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPRXLLXKXWVXEHY

SEQ ID NO: 255904 - protein, 24 aa, Artificial Sequence
  Description of Artificial Sequence: Synthetic peptide
  Seed: AGREHFAFGEPRELLTKVWVQEHY (MAGC1_HUMAN)
  Core: LLTKVWVQE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPREXLTXVXVQXHY

SEQ ID NO: 255905 - protein, 25 aa, Artificial Sequence
  Description of Artificial Sequence: Synthetic peptide
  Seed: AGREHFAFGEPRELLTKVWVQEHYL (MAGC1_HUMAN)
  Core: HFAFGEPRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AGREXFAXGXPRXLLTKVWVQEHYL

SEQ ID NO: 255906 - protein, 25 aa, Artificial Sequence
  Description of Artificial Sequence: Synthetic peptide
  Seed: AGREHFAFGEPRELLTKVWVQEHYL (MAGC1_HUMAN)
  Core: FAFGEPREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AGREHXAFXEXREXLTKVWVQEHYL

SEQ ID NO: 255907 - protein, 25 aa, Artificial Sequence
  Description of Artificial Sequence: Synthetic peptide
  Seed: AGREHFAFGEPRELLTKVWVQEHYL (MAGC1_HUMAN)
  Core: RELLTKVWV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPXELXTXVWXQEHYL

SEQ ID NO: 255908 - protein, 25 aa, Artificial Sequence
  Description of Artificial Sequence: Synthetic peptide
  Seed: AGREHFAFGEPRELLTKVWVQEHYL (MAGC1_HUMAN)
  Core: ELLTKVWVQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPRXLLXKXWVXEHYL

SEQ ID NO: 255909 - protein, 25 aa, Artificial Sequence
  Description of Artificial Sequence: Synthetic peptide
  Seed: AGREHFAFGEPRELLTKVWVQEHYL (MAGC1_HUMAN)
  Core: LLTKVWVQE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPREXLTXVXVQXHYL

SEQ ID NO: 255910 - protein, 25 aa, Artificial Sequence
  Description of Artificial Sequence: Synthetic peptide
  Seed: AGREHFAFGEPRELLTKVWVQEHYL (MAGC1_HUMAN)
  Core: LTKVWVQEH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AGREHFAFGEPRELXTKXWXQEXYL

SEQ ID NO: 255911 - protein, 15 aa, Artificial Sequence
  Description of Artificial Sequence: Synthetic peptide
  Seed: AHSEVIKRKVVEFLA (MAGC1_HUMAN)
  Core: EVIKRKVVE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AHSXVIXRXVVXFLA

SEQ ID NO: 255912 - protein, 15 aa, Artificial Sequence
  Description of Artificial Sequence: Synthetic peptide
  Seed: AHSEVIKRKVVEFLA (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLA

SEQ ID NO: 255913 - protein, 15 aa, Artificial Sequence
  Description of Artificial Sequence: Synthetic peptide
  Seed: AHSEVIKRKVVEFLA (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXA

SEQ ID NO: 255914 - protein, 16 aa, Artificial Sequence
  Description of Artificial Sequence: Synthetic peptide
  Seed: AHSEVIKRKVVEFLAM (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLAM

SEQ ID NO: 255915 - protein, 16 aa, Artificial Sequence
  Description of Artificial Sequence: Synthetic peptide
  Seed: AHSEVIKRKVVEFLAM (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAM

SEQ ID NO: 255916 - protein, 16 aa, Artificial Sequence
  Description of Artificial Sequence: Synthetic peptide
  Seed: AHSEVIKRKVVEFLAM (MAGC1_HUMAN)
  Core: KRKVVEFLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIXRKXVXFLXM

SEQ ID NO: 255917 - protein, 16 aa, Artificial Sequence
  Description of Artificial Sequence: Synthetic peptide
  Seed: AHSEVIKRKVVEFLAM (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAX

SEQ ID NO: 255918 - protein, 17 aa, Artificial Sequence
  Description of Artificial Sequence: Synthetic peptide
  Seed: AHSEVIKRKVVEFLAML (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLAML

SEQ ID NO: 255919 - protein, 17 aa, Artificial Sequence
  Description of Artificial Sequence: Synthetic peptide
  Seed: AHSEVIKRKVVEFLAML (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAML

SEQ ID NO: 255920 - protein, 17 aa, Artificial Sequence
  Description of Artificial Sequence: Synthetic peptide
  Seed: AHSEVIKRKVVEFLAML (MAGC1_HUMAN)
  Core: KRKVVEFLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIXRKXVXFLXML

SEQ ID NO: 255921 - protein, 17 aa, Artificial Sequence
  Description of Artificial Sequence: Synthetic peptide
  Seed: AHSEVIKRKVVEFLAML (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXL

SEQ ID NO: 255922 - protein, 18 aa, Artificial Sequence
  Description of Artificial Sequence: Synthetic peptide
  Seed: AHSEVIKRKVVEFLAMLK (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAMLK

SEQ ID NO: 255923 - protein, 18 aa, Artificial Sequence
  Description of Artificial Sequence: Synthetic peptide
  Seed: AHSEVIKRKVVEFLAMLK (MAGC1_HUMAN)
  Core: KRKVVEFLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIXRKXVXFLXMLK

SEQ ID NO: 255924 - protein, 18 aa, Artificial Sequence
  Description of Artificial Sequence: Synthetic peptide
  Seed: AHSEVIKRKVVEFLAMLK (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLK

SEQ ID NO: 255925 - protein, 19 aa, Artificial Sequence
  Description of Artificial Sequence: Synthetic peptide
  Seed: AHSEVIKRKVVEFLAMLKN (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLAMLKN

SEQ ID NO: 255926 - protein, 19 aa, Artificial Sequence
  Description of Artificial Sequence: Synthetic peptide
  Seed: AHSEVIKRKVVEFLAMLKN (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAMLKN

SEQ ID NO: 255927 - protein, 19 aa, Artificial Sequence
  Description of Artificial Sequence: Synthetic peptide
  Seed: AHSEVIKRKVVEFLAMLKN (MAGC1_HUMAN)
  Core: KRKVVEFLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIXRKXVXFLXMLKN

SEQ ID NO: 255928 - protein, 19 aa, Artificial Sequence
  Description of Artificial Sequence: Synthetic peptide
  Seed: AHSEVIKRKVVEFLAMLKN (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKN

SEQ ID NO: 255929 - protein, 19 aa, Artificial Sequence
  Description of Artificial Sequence: Synthetic peptide
  Seed: AHSEVIKRKVVEFLAMLKN (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXN

SEQ ID NO: 255930 - protein, 20 aa, Artificial Sequence
  Description of Artificial Sequence: Synthetic peptide
  Seed: AHSEVIKRKVVEFLAMLKNT (MAGC1_HUMAN)
  Core: EVIKRKVVE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AHSXVIXRXVVXFLAMLKNT

SEQ ID NO: 255931 - protein, 20 aa, Artificial Sequence
  Description of Artificial Sequence: Synthetic peptide
  Seed: AHSEVIKRKVVEFLAMLKNT (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLAMLKNT

SEQ ID NO: 255932 - protein, 20 aa, Artificial Sequence
  Description of Artificial Sequence: Synthetic peptide
  Seed: AHSEVIKRKVVEFLAMLKNT (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAMLKNT

SEQ ID NO: 255933 - protein, 20 aa, Artificial Sequence
  Description of Artificial Sequence: Synthetic peptide
  Seed: AHSEVIKRKVVEFLAMLKNT (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNT

SEQ ID NO: 255934 - protein, 20 aa, Artificial Sequence
  Description of Artificial Sequence: Synthetic peptide
  Seed: AHSEVIKRKVVEFLAMLKNT (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNT

SEQ ID NO: 255935 - protein, 20 aa, Artificial Sequence
  Description of Artificial Sequence: Synthetic peptide
  Seed: AHSEVIKRKVVEFLAMLKNT (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNT

SEQ ID NO: 255936 - protein, 20 aa, Artificial Sequence
  Description of Artificial Sequence: Synthetic peptide
  Seed: AHSEVIKRKVVEFLAMLKNT (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXT

SEQ ID NO: 255937 - protein, 21 aa, Artificial Sequence
  Description of Artificial Sequence: Synthetic peptide
  Seed: AHSEVIKRKVVEFLAMLKNTV (MAGC1_HUMAN)
  Core: EVIKRKVVE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AHSXVIXRXVVXFLAMLKNTV

SEQ ID NO: 255938 - protein, 21 aa, Artificial Sequence
  Description of Artificial Sequence: Synthetic peptide
  Seed: AHSEVIKRKVVEFLAMLKNTV (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAMLKNTV

SEQ ID NO: 255939 - protein, 21 aa, Artificial Sequence
  Description of Artificial Sequence: Synthetic peptide
  Seed: AHSEVIKRKVVEFLAMLKNTV (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNTV

SEQ ID NO: 255940 - protein, 21 aa, Artificial Sequence
  Description of Artificial Sequence: Synthetic peptide
  Seed: AHSEVIKRKVVEFLAMLKNTV (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNTV

SEQ ID NO: 255941 - protein, 21 aa, Artificial Sequence
  Description of Artificial Sequence: Synthetic peptide
  Seed: AHSEVIKRKVVEFLAMLKNTV (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNTV

SEQ ID NO: 255942 - protein, 21 aa, Artificial Sequence
  Description of Artificial Sequence: Synthetic peptide
  Seed: AHSEVIKRKVVEFLAMLKNTV (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXTV

SEQ ID NO: 255943 - protein, 21 aa, Artificial Sequence
  Description of Artificial Sequence: Synthetic peptide
  Seed: AHSEVIKRKVVEFLAMLKNTV (MAGC1_HUMAN)
  Core: FLAMLKNTV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEXLAXLXNTX

SEQ ID NO: 255944 - protein, 22 aa, Artificial Sequence
  Description of Artificial Sequence: Synthetic peptide
  Seed: AHSEVIKRKVVEFLAMLKNTVP (MAGC1_HUMAN)
  Core: EVIKRKVVE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AHSXVIXRXVVXFLAMLKNTVP

SEQ ID NO: 255945 - protein, 22 aa, Artificial Sequence
  Description of Artificial Sequence: Synthetic peptide
  Seed: AHSEVIKRKVVEFLAMLKNTVP (MAGC1_HUMAN)
  Core: IKRKVVEFL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVXKRXVXEFXAMLKNTVP

SEQ ID NO: 255946 - protein, 22 aa, Artificial Sequence
  Description of Artificial Sequence: Synthetic peptide
  Seed: AHSEVIKRKVVEFLAMLKNTVP (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNTVP

SEQ ID NO: 255947 - protein, 22 aa, Artificial Sequence
  Description of Artificial Sequence: Synthetic peptide
  Seed: AHSEVIKRKVVEFLAMLKNTVP (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNTVP

SEQ ID NO: 255948 - protein, 22 aa, Artificial Sequence
  Description of Artificial Sequence: Synthetic peptide
  Seed: AHSEVIKRKVVEFLAMLKNTVP (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNTVP

SEQ ID NO: 255949 - protein, 22 aa, Artificial Sequence
  Description of Artificial Sequence: Synthetic peptide
  Seed: AHSEVIKRKVVEFLAMLKNTVP (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXTVP

SEQ ID NO: 255950 - protein, 22 aa, Artificial Sequence
  Description of Artificial Sequence: Synthetic peptide
  Seed: AHSEVIKRKVVEFLAMLKNTVP (MAGC1_HUMAN)
  Core: FLAMLKNTV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEXLAXLXNTXP

SEQ ID NO: 255951 - protein, 23 aa, Artificial Sequence
  Description of Artificial Sequence: Synthetic peptide
  Seed: AHSEVIKRKVVEFLAMLKNTVPI (MAGC1_HUMAN)
  Core: EVIKRKVVE
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AHSXVIXRXVVXFLAMLKNTVPI

SEQ ID NO: 255952 - protein, 23 aa, Artificial Sequence
  Description of Artificial Sequence: Synthetic peptide
  Seed: AHSEVIKRKVVEFLAMLKNTVPI (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNTVPI

SEQ ID NO: 255953 - protein, 23 aa, Artificial Sequence
  Description of Artificial Sequence: Synthetic peptide
  Seed: AHSEVIKRKVVEFLAMLKNTVPI (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNTVPI

SEQ ID NO: 255954 - protein, 23 aa, Artificial Sequence
  Description of Artificial Sequence: Synthetic peptide
  Seed: AHSEVIKRKVVEFLAMLKNTVPI (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNTVPI

SEQ ID NO: 255955 - protein, 23 aa, Artificial Sequence
  Description of Artificial Sequence: Synthetic peptide
  Seed: AHSEVIKRKVVEFLAMLKNTVPI (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXTVPI

SEQ ID NO: 255956 - protein, 23 aa, Artificial Sequence
  Description of Artificial Sequence: Synthetic peptide
  Seed: AHSEVIKRKVVEFLAMLKNTVPI (MAGC1_HUMAN)
  Core: FLAMLKNTV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEXLAXLXNTXPI

SEQ ID NO: 255957 - protein, 23 aa, Artificial Sequence
  Description of Artificial Sequence: Synthetic peptide
  Seed: AHSEVIKRKVVEFLAMLKNTVPI (MAGC1_HUMAN)
  Core: LAMLKNTVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEFXAMXKXTVXI

SEQ ID NO: 255958 - protein, 24 aa, Artificial Sequence
  Description of Artificial Sequence: Synthetic peptide
  Seed: AHSEVIKRKVVEFLAMLKNTVPIT (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNTVPIT

SEQ ID NO: 255959 - protein, 24 aa, Artificial Sequence
  Description of Artificial Sequence: Synthetic peptide
  Seed: AHSEVIKRKVVEFLAMLKNTVPIT (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNTVPIT

SEQ ID NO: 255960 - protein, 24 aa, Artificial Sequence
  Description of Artificial Sequence: Synthetic peptide
  Seed: AHSEVIKRKVVEFLAMLKNTVPIT (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNTVPIT

SEQ ID NO: 255961 - protein, 24 aa, Artificial Sequence
  Description of Artificial Sequence: Synthetic peptide
  Seed: AHSEVIKRKVVEFLAMLKNTVPIT (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXTVPIT

SEQ ID NO: 255962 - protein, 24 aa, Artificial Sequence
  Description of Artificial Sequence: Synthetic peptide
  Seed: AHSEVIKRKVVEFLAMLKNTVPIT (MAGC1_HUMAN)
  Core: FLAMLKNTV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEXLAXLXNTXPIT

SEQ ID NO: 255963 - protein, 24 aa, Artificial Sequence
  Description of Artificial Sequence: Synthetic peptide
  Seed: AHSEVIKRKVVEFLAMLKNTVPIT (MAGC1_HUMAN)
  Core: LAMLKNTVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEFXAMXKXTVXIT

SEQ ID NO: 255964 - protein, 25 aa, Artificial Sequence
  Description of Artificial Sequence: Synthetic peptide
  Seed: AHSEVIKRKVVEFLAMLKNTVPITF (MAGC1_HUMAN)
  Core: VIKRKVVEF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AHSEXIKXKXVEXLAMLKNTVPITF

SEQ ID NO: 255965 - protein, 25 aa, Artificial Sequence
  Description of Artificial Sequence: Synthetic peptide
  Seed: AHSEVIKRKVVEFLAMLKNTVPITF (MAGC1_HUMAN)
  Core: RKVVEFLAM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKXKVXEXLAXLKNTVPITF

SEQ ID NO: 255966 - protein, 25 aa, Artificial Sequence
  Description of Artificial Sequence: Synthetic peptide
  Seed: AHSEVIKRKVVEFLAMLKNTVPITF (MAGC1_HUMAN)
  Core: KVVEFLAML
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRXVVXFXAMXKNTVPITF

SEQ ID NO: 255967 - protein, 25 aa, Artificial Sequence
  Description of Artificial Sequence: Synthetic peptide
  Seed: AHSEVIKRKVVEFLAMLKNTVPITF (MAGC1_HUMAN)
  Core: VVEFLAMLK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKXVEXLXMLXNTVPITF

SEQ ID NO: 255968 - protein, 25 aa, Artificial Sequence
  Description of Artificial Sequence: Synthetic peptide
  Seed: AHSEVIKRKVVEFLAMLKNTVPITF (MAGC1_HUMAN)
  Core: VEFLAMLKN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVXEFXAXLKXTVPITF

SEQ ID NO: 255969 - protein, 25 aa, Artificial Sequence
  Description of Artificial Sequence: Synthetic peptide
  Seed: AHSEVIKRKVVEFLAMLKNTVPITF (MAGC1_HUMAN)
  Core: FLAMLKNTV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEXLAXLXNTXPITF

SEQ ID NO: 255970 - protein, 25 aa, Artificial Sequence
  Description of Artificial Sequence: Synthetic peptide
  Seed: AHSEVIKRKVVEFLAMLKNTVPITF (MAGC1_HUMAN)
  Core: LAMLKNTVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AHSEVIKRKVVEFXAMXKXTVXITF

SEQ ID NO: 255971 - protein, 19 aa, Artificial Sequence
  Description of Artificial Sequence: Synthetic peptide
  Seed: AIIDTTDDSTATESASSSV (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSV

SEQ ID NO: 255972 - protein, 20 aa, Artificial Sequence
  Description of Artificial Sequence: Synthetic peptide
  Seed: AIIDTTDDSTATESASSSVM (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVM

SEQ ID NO: 255973 - protein, 21 aa, Artificial Sequence
  Description of Artificial Sequence: Synthetic peptide
  Seed: AIIDTTDDSTATESASSSVMS (MAGC1_HUMAN)
  Core: DSTATESAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDXSTXTXSAXSSVMS

SEQ ID NO: 255974 - protein, 21 aa, Artificial Sequence
  Description of Artificial Sequence: Synthetic peptide
  Seed: AIIDTTDDSTATESASSSVMS (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVMS

SEQ ID NO: 255975 - protein, 22 aa, Artificial Sequence
  Description of Artificial Sequence: Synthetic peptide
  Seed: AIIDTTDDSTATESASSSVMSP (MAGC1_HUMAN)
  Core: DSTATESAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDXSTXTXSAXSSVMSP

SEQ ID NO: 255976 - protein, 22 aa, Artificial Sequence
  Description of Artificial Sequence: Synthetic peptide
  Seed: AIIDTTDDSTATESASSSVMSP (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVMSP

SEQ ID NO: 255977 - protein, 23 aa, Artificial Sequence
  Description of Artificial Sequence: Synthetic peptide
  Seed: AIIDTTDDSTATESASSSVMSPS (MAGC1_HUMAN)
  Core: DSTATESAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDXSTXTXSAXSSVMSPS

SEQ ID NO: 255978 - protein, 23 aa, Artificial Sequence
  Description of Artificial Sequence: Synthetic peptide
  Seed: AIIDTTDDSTATESASSSVMSPS (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVMSPS

SEQ ID NO: 255979 - protein, 23 aa, Artificial Sequence
  Description of Artificial Sequence: Synthetic peptide
  Seed: AIIDTTDDSTATESASSSVMSPS (MAGC1_HUMAN)
  Core: TESASSSVM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDSTAXESXSXSVXSPS

SEQ ID NO: 255980 - protein, 24 aa, Artificial Sequence
  Description of Artificial Sequence: Synthetic peptide
  Seed: AIIDTTDDSTATESASSSVMSPSF (MAGC1_HUMAN)
  Core: DSTATESAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDXSTXTXSAXSSVMSPSF

SEQ ID NO: 255981 - protein, 24 aa, Artificial Sequence
  Description of Artificial Sequence: Synthetic peptide
  Seed: AIIDTTDDSTATESASSSVMSPSF (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVMSPSF

SEQ ID NO: 255982 - protein, 24 aa, Artificial Sequence
  Description of Artificial Sequence: Synthetic peptide
  Seed: AIIDTTDDSTATESASSSVMSPSF (MAGC1_HUMAN)
  Core: TATESASSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDSXATXSXSSXVMSPSF

SEQ ID NO: 255983 - protein, 24 aa, Artificial Sequence
  Description of Artificial Sequence: Synthetic peptide
  Seed: AIIDTTDDSTATESASSSVMSPSF (MAGC1_HUMAN)
  Core: TESASSSVM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDSTAXESXSXSVXSPSF

SEQ ID NO: 255984 - protein, 25 aa, Artificial Sequence
  Description of Artificial Sequence: Synthetic peptide
  Seed: AIIDTTDDSTATESASSSVMSPSFS (MAGC1_HUMAN)
  Core: IDTTDDSTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AIXDTXDXSTXTESASSSVMSPSFS

SEQ ID NO: 255985 - protein, 25 aa, Artificial Sequence
  Description of Artificial Sequence: Synthetic peptide
  Seed: AIIDTTDDSTATESASSSVMSPSFS (MAGC1_HUMAN)
  Core: DSTATESAS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDXSTXTXSAXSSVMSPSFS

SEQ ID NO: 255986 - protein, 25 aa, Artificial Sequence
  Description of Artificial Sequence: Synthetic peptide
  Seed: AIIDTTDDSTATESASSSVMSPSFS (MAGC1_HUMAN)
  Core: STATESASS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDXTAXEXASXSVMSPSFS

SEQ ID NO: 255987 - protein, 25 aa, Artificial Sequence
  Description of Artificial Sequence: Synthetic peptide
  Seed: AIIDTTDDSTATESASSSVMSPSFS (MAGC1_HUMAN)
  Core: TATESASSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDSXATXSXSSXVMSPSFS

SEQ ID NO: 255988 - protein, 25 aa, Artificial Sequence
  Description of Artificial Sequence: Synthetic peptide
  Seed: AIIDTTDDSTATESASSSVMSPSFS (MAGC1_HUMAN)
  Core: TESASSSVM
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AIIDTTDDSTAXESXSXSVXSPSFS

SEQ ID NO: 255989 - protein, 20 aa, Artificial Sequence
  Description of Artificial Sequence: Synthetic peptide
  Seed: ALKDVEERAQAIIDTTDDST (MAGC1_HUMAN)
  Core: AQAIIDTTD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALKDVEERXQAXIXTTXDST

SEQ ID NO: 255990 - protein, 23 aa, Artificial Sequence
  Description of Artificial Sequence: Synthetic peptide
  Seed: ALKDVEERAQAIIDTTDDSTATE (MAGC1_HUMAN)
  Core: AQAIIDTTD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALKDVEERXQAXIXTTXDSTATE

SEQ ID NO: 255991 - protein, 24 aa, Artificial Sequence
  Description of Artificial Sequence: Synthetic peptide
  Seed: ALKDVEERAQAIIDTTDDSTATES (MAGC1_HUMAN)
  Core: AQAIIDTTD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALKDVEERXQAXIXTTXDSTATES

SEQ ID NO: 255992 - protein, 25 aa, Artificial Sequence
  Description of Artificial Sequence: Synthetic peptide
  Seed: ALKDVEERAQAIIDTTDDSTATESA (MAGC1_HUMAN)
  Core: AQAIIDTTD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ALKDVEERXQAXIXTTXDSTATESA

SEQ ID NO: 255993 - protein, 13 aa, Artificial Sequence
  Description of Artificial Sequence: Synthetic peptide
  Seed: ALLSIFQSSPEST (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXST

SEQ ID NO: 255994 - protein, 14 aa, Artificial Sequence
  Description of Artificial Sequence: Synthetic peptide
  Seed: ALLSIFQSSPESTQ (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQ

SEQ ID NO: 255995 - protein, 14 aa, Artificial Sequence
  Description of Artificial Sequence: Synthetic peptide
  Seed: ALLSIFQSSPESTQ (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQ

SEQ ID NO: 255996 - protein, 15 aa, Artificial Sequence
  Description of Artificial Sequence: Synthetic peptide
  Seed: ALLSIFQSSPESTQS (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQS

SEQ ID NO: 255997 - protein, 15 aa, Artificial Sequence
  Description of Artificial Sequence: Synthetic peptide
  Seed: ALLSIFQSSPESTQS (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQS

SEQ ID NO: 255998 - protein, 15 aa, Artificial Sequence
  Description of Artificial Sequence: Synthetic peptide
  Seed: ALLSIFQSSPESTQS (MAGC1_HUMAN)
  Core: FQSSPESTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLSIXQSXPXSTXS

SEQ ID NO: 255999 - protein, 16 aa, Artificial Sequence
  Description of Artificial Sequence: Synthetic peptide
  Seed: ALLSIFQSSPESTQSP (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSP

SEQ ID NO: 256000 - protein, 16 aa, Artificial Sequence
  Description of Artificial Sequence: Synthetic peptide
  Seed: ALLSIFQSSPESTQSP (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSP

SEQ ID NO: 256001 - protein, 17 aa, Artificial Sequence
  Description of Artificial Sequence: Synthetic peptide
  Seed: ALLSIFQSSPESTQSPF (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPF

SEQ ID NO: 256002 - protein, 17 aa, Artificial Sequence
  Description of Artificial Sequence: Synthetic peptide
  Seed: ALLSIFQSSPESTQSPF (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPF

SEQ ID NO: 256003 - protein, 18 aa, Artificial Sequence
  Description of Artificial Sequence: Synthetic peptide
  Seed: ALLSIFQSSPESTQSPFE (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFE

SEQ ID NO: 256004 - protein, 19 aa, Artificial Sequence
  Description of Artificial Sequence: Synthetic peptide
  Seed: ALLSIFQSSPESTQSPFEG (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEG

SEQ ID NO: 256005 - protein, 19 aa, Artificial Sequence
  Description of Artificial Sequence: Synthetic peptide
  Seed: ALLSIFQSSPESTQSPFEG (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEG

SEQ ID NO: 256006 - protein, 20 aa, Artificial Sequence
  Description of Artificial Sequence: Synthetic peptide
  Seed: ALLSIFQSSPESTQSPFEGF (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGF

SEQ ID NO: 256007 - protein, 20 aa, Artificial Sequence
  Description of Artificial Sequence: Synthetic peptide
  Seed: ALLSIFQSSPESTQSPFEGF (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGF

SEQ ID NO: 256008 - protein, 20 aa, Artificial Sequence
  Description of Artificial Sequence: Synthetic peptide
  Seed: ALLSIFQSSPESTQSPFEGF (MAGC1_HUMAN)
  Core: FQSSPESTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLSIXQSXPXSTXSPFEGF

SEQ ID NO: 256009 - protein, 21 aa, Artificial Sequence
  Description of Artificial Sequence: Synthetic peptide
  Seed: ALLSIFQSSPESTQSPFEGFP (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGFP

SEQ ID NO: 256010 - protein, 21 aa, Artificial Sequence
  Description of Artificial Sequence: Synthetic peptide
  Seed: ALLSIFQSSPESTQSPFEGFP (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGFP

SEQ ID NO: 256011 - protein, 22 aa, Artificial Sequence
  Description of Artificial Sequence: Synthetic peptide
  Seed: ALLSIFQSSPESTQSPFEGFPQ (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGFPQ

SEQ ID NO: 256012 - protein, 22 aa, Artificial Sequence
  Description of Artificial Sequence: Synthetic peptide
  Seed: ALLSIFQSSPESTQSPFEGFPQ (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGFPQ

SEQ ID NO: 256013 - protein, 23 aa, Artificial Sequence
  Description of Artificial Sequence: Synthetic peptide
  Seed: ALLSIFQSSPESTQSPFEGFPQS (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGFPQS

SEQ ID NO: 256014 - protein, 23 aa, Artificial Sequence
  Description of Artificial Sequence: Synthetic peptide
  Seed: ALLSIFQSSPESTQSPFEGFPQS (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGFPQS

SEQ ID NO: 256015 - protein, 24 aa, Artificial Sequence
  Description of Artificial Sequence: Synthetic peptide
  Seed: ALLSIFQSSPESTQSPFEGFPQSV (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGFPQSV

SEQ ID NO: 256016 - protein, 24 aa, Artificial Sequence
  Description of Artificial Sequence: Synthetic peptide
  Seed: ALLSIFQSSPESTQSPFEGFPQSV (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGFPQSV

SEQ ID NO: 256017 - protein, 25 aa, Artificial Sequence
  Description of Artificial Sequence: Synthetic peptide
  Seed: ALLSIFQSSPESTQSPFEGFPQSVL (MAGC1_HUMAN)
  Core: LSIFQSSPE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ALXSIXQXSPXSTQSPFEGFPQSVL

SEQ ID NO: 256018 - protein, 25 aa, Artificial Sequence
  Description of Artificial Sequence: Synthetic peptide
  Seed: ALLSIFQSSPESTQSPFEGFPQSVL (MAGC1_HUMAN)
  Core: IFQSSPEST
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ALLSXFQXSXESXQSPFEGFPQSVL

SEQ ID NO: 256019 - protein, 25 aa, Artificial Sequence
  Description of Artificial Sequence: Synthetic peptide
  Seed: ALLSIFQSSPESTQSPFEGFPQSVL (MAGC1_HUMAN)
  Core: FQSSPESTQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ALLSIXQSXPXSTXSPFEGFPQSVL

SEQ ID NO: 256020 - protein, 25 aa, Artificial Sequence
  Description of Artificial Sequence: Synthetic peptide
  Seed: ALLSIFQSSPESTQSPFEGFPQSVL (MAGC1_HUMAN)
  Core: STQSPFEGF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ALLSIFQSSPEXTQXPXEGXPQSVL

SEQ ID NO: 256021 - protein, 13 aa, Artificial Sequence
  Description of Artificial Sequence: Synthetic peptide
  Seed: AMLKNTVPITFPS (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPS

SEQ ID NO: 256022 - protein, 14 aa, Artificial Sequence
  Description of Artificial Sequence: Synthetic peptide
  Seed: AMLKNTVPITFPSS (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSS

SEQ ID NO: 256023 - protein, 15 aa, Artificial Sequence
  Description of Artificial Sequence: Synthetic peptide
  Seed: AMLKNTVPITFPSSY (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSY

SEQ ID NO: 256024 - protein, 15 aa, Artificial Sequence
  Description of Artificial Sequence: Synthetic peptide
  Seed: AMLKNTVPITFPSSY (MAGC1_HUMAN)
  Core: NTVPITFPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMLKXTVXIXFPXSY

SEQ ID NO: 256025 - protein, 16 aa, Artificial Sequence
  Description of Artificial Sequence: Synthetic peptide
  Seed: AMLKNTVPITFPSSYK (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYK

SEQ ID NO: 256026 - protein, 16 aa, Artificial Sequence
  Description of Artificial Sequence: Synthetic peptide
  Seed: AMLKNTVPITFPSSYK (MAGC1_HUMAN)
  Core: NTVPITFPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMLKXTVXIXFPXSYK

SEQ ID NO: 256027 - protein, 16 aa, Artificial Sequence
  Description of Artificial Sequence: Synthetic peptide
  Seed: AMLKNTVPITFPSSYK (MAGC1_HUMAN)
  Core: TVPITFPSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNXVPXTXPSXYK

SEQ ID NO: 256028 - protein, 17 aa, Artificial Sequence
  Description of Artificial Sequence: Synthetic peptide
  Seed: AMLKNTVPITFPSSYKD (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKD

SEQ ID NO: 256029 - protein, 17 aa, Artificial Sequence
  Description of Artificial Sequence: Synthetic peptide
  Seed: AMLKNTVPITFPSSYKD (MAGC1_HUMAN)
  Core: NTVPITFPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AMLKXTVXIXFPXSYKD

SEQ ID NO: 256030 - protein, 17 aa, Artificial Sequence
  Description of Artificial Sequence: Synthetic peptide
  Seed: AMLKNTVPITFPSSYKD (MAGC1_HUMAN)
  Core: TVPITFPSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNXVPXTXPSXYKD

SEQ ID NO: 256031 - protein, 19 aa, Artificial Sequence
  Description of Artificial Sequence: Synthetic peptide
  Seed: AMLKNTVPITFPSSYKDAL (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDAL

SEQ ID NO: 256032 - protein, 19 aa, Artificial Sequence
  Description of Artificial Sequence: Synthetic peptide
  Seed: AMLKNTVPITFPSSYKDAL (MAGC1_HUMAN)
  Core: TVPITFPSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNXVPXTXPSXYKDAL

SEQ ID NO: 256033 - protein, 20 aa, Artificial Sequence
  Description of Artificial Sequence: Synthetic peptide
  Seed: AMLKNTVPITFPSSYKDALK (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALK

SEQ ID NO: 256034 - protein, 20 aa, Artificial Sequence
  Description of Artificial Sequence: Synthetic peptide
  Seed: AMLKNTVPITFPSSYKDALK (MAGC1_HUMAN)
  Core: TVPITFPSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNXVPXTXPSXYKDALK

SEQ ID NO: 256035 - protein, 20 aa, Artificial Sequence
  Description of Artificial Sequence: Synthetic peptide
  Seed: AMLKNTVPITFPSSYKDALK (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALK

SEQ ID NO: 256036 - protein, 21 aa, Artificial Sequence
  Description of Artificial Sequence: Synthetic peptide
  Seed: AMLKNTVPITFPSSYKDALKD (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALKD

SEQ ID NO: 256037 - protein, 21 aa, Artificial Sequence
  Description of Artificial Sequence: Synthetic peptide
  Seed: AMLKNTVPITFPSSYKDALKD (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALKD

SEQ ID NO: 256038 - protein, 22 aa, Artificial Sequence
  Description of Artificial Sequence: Synthetic peptide
  Seed: AMLKNTVPITFPSSYKDALKDV (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALKDV

SEQ ID NO: 256039 - protein, 22 aa, Artificial Sequence
  Description of Artificial Sequence: Synthetic peptide
  Seed: AMLKNTVPITFPSSYKDALKDV (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALKDV

SEQ ID NO: 256040 - protein, 22 aa, Artificial Sequence
  Description of Artificial Sequence: Synthetic peptide
  Seed: AMLKNTVPITFPSSYKDALKDV (MAGC1_HUMAN)
  Core: PSSYKDALK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFXSSXKXALXDV

SEQ ID NO: 256041 - protein, 23 aa, Artificial Sequence
  Description of Artificial Sequence: Synthetic peptide
  Seed: AMLKNTVPITFPSSYKDALKDVE (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALKDVE

SEQ ID NO: 256042 - protein, 23 aa, Artificial Sequence
  Description of Artificial Sequence: Synthetic peptide
  Seed: AMLKNTVPITFPSSYKDALKDVE (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALKDVE

SEQ ID NO: 256043 - protein, 23 aa, Artificial Sequence
  Description of Artificial Sequence: Synthetic peptide
  Seed: AMLKNTVPITFPSSYKDALKDVE (MAGC1_HUMAN)
  Core: PSSYKDALK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFXSSXKXALXDVE

SEQ ID NO: 256044 - protein, 23 aa, Artificial Sequence
  Description of Artificial Sequence: Synthetic peptide
  Seed: AMLKNTVPITFPSSYKDALKDVE (MAGC1_HUMAN)
  Core: SSYKDALKD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFPXSYXDXLKXVE

SEQ ID NO: 256045 - protein, 24 aa, Artificial Sequence
  Description of Artificial Sequence: Synthetic peptide
  Seed: AMLKNTVPITFPSSYKDALKDVEE (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALKDVEE

SEQ ID NO: 256046 - protein, 24 aa, Artificial Sequence
  Description of Artificial Sequence: Synthetic peptide
  Seed: AMLKNTVPITFPSSYKDALKDVEE (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALKDVEE

SEQ ID NO: 256047 - protein, 24 aa, Artificial Sequence
  Description of Artificial Sequence: Synthetic peptide
  Seed: AMLKNTVPITFPSSYKDALKDVEE (MAGC1_HUMAN)
  Core: PSSYKDALK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFXSSXKXALXDVEE

SEQ ID NO: 256048 - protein, 24 aa, Artificial Sequence
  Description of Artificial Sequence: Synthetic peptide
  Seed: AMLKNTVPITFPSSYKDALKDVEE (MAGC1_HUMAN)
  Core: SSYKDALKD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFPXSYXDXLKXVEE

SEQ ID NO: 256049 - protein, 25 aa, Artificial Sequence
  Description of Artificial Sequence: Synthetic peptide
  Seed: AMLKNTVPITFPSSYKDALKDVEER (MAGC1_HUMAN)
  Core: LKNTVPITF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
AMXKNXVXITXPSSYKDALKDVEER

SEQ ID NO: 256050 - protein, 25 aa, Artificial Sequence
  Description of Artificial Sequence: Synthetic peptide
  Seed: AMLKNTVPITFPSSYKDALKDVEER (MAGC1_HUMAN)
  Core: TVPITFPSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNXVPXTXPSXYKDALKDVEER

SEQ ID NO: 256051 - protein, 25 aa, Artificial Sequence
  Description of Artificial Sequence: Synthetic peptide
  Seed: AMLKNTVPITFPSSYKDALKDVEER (MAGC1_HUMAN)
  Core: ITFPSSYKD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPXTFXSXYKXALKDVEER

SEQ ID NO: 256052 - protein, 25 aa, Artificial Sequence
  Description of Artificial Sequence: Synthetic peptide
  Seed: AMLKNTVPITFPSSYKDALKDVEER (MAGC1_HUMAN)
  Core: PSSYKDALK
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFXSSXKXALXDVEER

SEQ ID NO: 256053 - protein, 25 aa, Artificial Sequence
  Description of Artificial Sequence: Synthetic peptide
  Seed: AMLKNTVPITFPSSYKDALKDVEER (MAGC1_HUMAN)
  Core: SSYKDALKD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFPXSYXDXLKXVEER

SEQ ID NO: 256054 - protein, 25 aa, Artificial Sequence
  Description of Artificial Sequence: Synthetic peptide
  Seed: AMLKNTVPITFPSSYKDALKDVEER (MAGC1_HUMAN)
  Core: YKDALKDVE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
AMLKNTVPITFPSSXKDXLXDVXER

SEQ ID NO: 256055 - protein, 20 aa, Artificial Sequence
  Description of Artificial Sequence: Synthetic peptide
  Seed: APEGEDSLSPLQIPQSPLEG (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEG

SEQ ID NO: 256056 - protein, 21 aa, Artificial Sequence
  Description of Artificial Sequence: Synthetic peptide
  Seed: APEGEDSLSPLQIPQSPLEGE (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEGE

SEQ ID NO: 256057 - protein, 22 aa, Artificial Sequence
  Description of Artificial Sequence: Synthetic peptide
  Seed: APEGEDSLSPLQIPQSPLEGED (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEGED

SEQ ID NO: 256058 - protein, 23 aa, Artificial Sequence
  Description of Artificial Sequence: Synthetic peptide
  Seed: APEGEDSLSPLQIPQSPLEGEDS (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEGEDS

SEQ ID NO: 256059 - protein, 24 aa, Artificial Sequence
  Description of Artificial Sequence: Synthetic peptide
  Seed: APEGEDSLSPLQIPQSPLEGEDSL (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEGEDSL

SEQ ID NO: 256060 - protein, 25 aa, Artificial Sequence
  Description of Artificial Sequence: Synthetic peptide
  Seed: APEGEDSLSPLQIPQSPLEGEDSLS (MAGC1_HUMAN)
  Core: LSPLQIPQS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
APEGEDSXSPXQXPQXPLEGEDSLS

SEQ ID NO: 256061 - protein, 20 aa, Artificial Sequence
  Description of Artificial Sequence: Synthetic peptide
  Seed: AQAIIDTTDDSTATESASSS (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXS

SEQ ID NO: 256062 - protein, 21 aa, Artificial Sequence
  Description of Artificial Sequence: Synthetic peptide
  Seed: AQAIIDTTDDSTATESASSSV (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXSV

SEQ ID NO: 256063 - protein, 22 aa, Artificial Sequence
  Description of Artificial Sequence: Synthetic peptide
  Seed: AQAIIDTTDDSTATESASSSVM (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXSVM

SEQ ID NO: 256064 - protein, 23 aa, Artificial Sequence
  Description of Artificial Sequence: Synthetic peptide
  Seed: AQAIIDTTDDSTATESASSSVMS (MAGC1_HUMAN)
  Core: DSTATESAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDXSTXTXSAXSSVMS

SEQ ID NO: 256065 - protein, 23 aa, Artificial Sequence
  Description of Artificial Sequence: Synthetic peptide
  Seed: AQAIIDTTDDSTATESASSSVMS (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXSVMS

SEQ ID NO: 256066 - protein, 24 aa, Artificial Sequence
  Description of Artificial Sequence: Synthetic peptide
  Seed: AQAIIDTTDDSTATESASSSVMSP (MAGC1_HUMAN)
  Core: DSTATESAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDXSTXTXSAXSSVMSP

SEQ ID NO: 256067 - protein, 24 aa, Artificial Sequence
  Description of Artificial Sequence: Synthetic peptide
  Seed: AQAIIDTTDDSTATESASSSVMSP (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXSVMSP

SEQ ID NO: 256068 - protein, 25 aa, Artificial Sequence
  Description of Artificial Sequence: Synthetic peptide
  Seed: AQAIIDTTDDSTATESASSSVMSPS (MAGC1_HUMAN)
  Core: DSTATESAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDXSTXTXSAXSSVMSPS

SEQ ID NO: 256069 - protein, 25 aa, Artificial Sequence
  Description of Artificial Sequence: Synthetic peptide
  Seed: AQAIIDTTDDSTATESASSSVMSPS (MAGC1_HUMAN)
  Core: STATESASS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDXTAXEXASXSVMSPS

SEQ ID NO: 256070 - protein, 25 aa, Artificial Sequence
  Description of Artificial Sequence: Synthetic peptide
  Seed: AQAIIDTTDDSTATESASSSVMSPS (MAGC1_HUMAN)
  Core: TATESASSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDSXATXSXSSXVMSPS

SEQ ID NO: 256071 - protein, 25 aa, Artificial Sequence
  Description of Artificial Sequence: Synthetic peptide
  Seed: AQAIIDTTDDSTATESASSSVMSPS (MAGC1_HUMAN)
  Core: TESASSSVM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AQAIIDTTDDSTAXESXSXSVXSPS

SEQ ID NO: 256072 - protein, 14 aa, Artificial Sequence
  Description of Artificial Sequence: Synthetic peptide
  Seed: AQSAFEGFPQSPLQ (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQ

SEQ ID NO: 256073 - protein, 15 aa, Artificial Sequence
  Description of Artificial Sequence: Synthetic peptide
  Seed: AQSAFEGFPQSPLQI (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQI

SEQ ID NO: 256074 - protein, 16 aa, Artificial Sequence
  Description of Artificial Sequence: Synthetic peptide
  Seed: AQSAFEGFPQSPLQIP (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIP

SEQ ID NO: 256075 - protein, 17 aa, Artificial Sequence
  Description of Artificial Sequence: Synthetic peptide
  Seed: AQSAFEGFPQSPLQIPV (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPV

SEQ ID NO: 256076 - protein, 19 aa, Artificial Sequence
  Description of Artificial Sequence: Synthetic peptide
  Seed: AQSAFEGFPQSPLQIPVSS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSS

SEQ ID NO: 256077 - protein, 20 aa, Artificial Sequence
  Description of Artificial Sequence: Synthetic peptide
  Seed: AQSAFEGFPQSPLQIPVSSS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSS

SEQ ID NO: 256078 - protein, 21 aa, Artificial Sequence
  Description of Artificial Sequence: Synthetic peptide
  Seed: AQSAFEGFPQSPLQIPVSSSF (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSSF

SEQ ID NO: 256079 - protein, 22 aa, Artificial Sequence
  Description of Artificial Sequence: Synthetic peptide
  Seed: AQSAFEGFPQSPLQIPVSSSFS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSSFS

SEQ ID NO: 256080 - protein, 23 aa, Artificial Sequence
  Description of Artificial Sequence: Synthetic peptide
  Seed: AQSAFEGFPQSPLQIPVSSSFSY (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSSFSY

SEQ ID NO: 256081 - protein, 24 aa, Artificial Sequence
  Description of Artificial Sequence: Synthetic peptide
  Seed: AQSAFEGFPQSPLQIPVSSSFSYT (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSSFSYT

SEQ ID NO: 256082 - protein, 25 aa, Artificial Sequence
  Description of Artificial Sequence: Synthetic peptide
  Seed: AQSAFEGFPQSPLQIPVSSSFSYTL (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSAXEGXPXSPXQIPVSSSFSYTL

SEQ ID NO: 256083 - protein, 25 aa, Artificial Sequence
  Description of Artificial Sequence: Synthetic peptide
  Seed: AQSAFEGFPQSPLQIPVSSSFSYTL (MAGC1_HUMAN)
  Core: QSPLQIPVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
AQSAFEGFPXSPXQXPVXSSFSYTL

SEQ ID NO: 256084 - protein, 17 aa, Artificial Sequence
  Description of Artificial Sequence: Synthetic peptide
  Seed: AQSPLQIPVSPSSSSTL (MAGC1_HUMAN)
  Core: PLQIPVSPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQSXLQXPXSPXSSSTL

SEQ ID NO: 256085 - protein, 19 aa, Artificial Sequence
  Description of Artificial Sequence: Synthetic peptide
  Seed: AQSPLQIPVSPSSSSTLLS (MAGC1_HUMAN)
  Core: PLQIPVSPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQSXLQXPXSPXSSSTLLS

SEQ ID NO: 256086 - protein, 19 aa, Artificial Sequence
  Description of Artificial Sequence: Synthetic peptide
  Seed: AQSPLQIPVSPSSSSTLLS (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLX

SEQ ID NO: 256087 - protein, 20 aa, Artificial Sequence
  Description of Artificial Sequence: Synthetic peptide
  Seed: AQSPLQIPVSPSSSSTLLSL (MAGC1_HUMAN)
  Core: QIPVSPSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXIPXSXSSXSTLLSL

SEQ ID NO: 256088 - protein, 20 aa, Artificial Sequence
  Description of Artificial Sequence: Synthetic peptide
  Seed: AQSPLQIPVSPSSSSTLLSL (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSL

SEQ ID NO: 256089 - protein, 20 aa, Artificial Sequence
  Description of Artificial Sequence: Synthetic peptide
  Seed: AQSPLQIPVSPSSSSTLLSL (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXL

SEQ ID NO: 256090 - protein, 21 aa, Artificial Sequence
  Description of Artificial Sequence: Synthetic peptide
  Seed: AQSPLQIPVSPSSSSTLLSLF (MAGC1_HUMAN)
  Core: LQIPVSPSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSPXQIXVXPSXSSTLLSLF

SEQ ID NO: 256091 - protein, 21 aa, Artificial Sequence
  Description of Artificial Sequence: Synthetic peptide
  Seed: AQSPLQIPVSPSSSSTLLSLF (MAGC1_HUMAN)
  Core: QIPVSPSSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXIPXSXSSXSTLLSLF

SEQ ID NO: 256092 - protein, 21 aa, Artificial Sequence
  Description of Artificial Sequence: Synthetic peptide
  Seed: AQSPLQIPVSPSSSSTLLSLF (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSLF

SEQ ID NO: 256093 - protein, 21 aa, Artificial Sequence
  Description of Artificial Sequence: Synthetic peptide
  Seed: AQSPLQIPVSPSSSSTLLSLF (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXLF

SEQ ID NO: 256094 - protein, 22 aa, Artificial Sequence
  Description of Artificial Sequence: Synthetic peptide
  Seed: AQSPLQIPVSPSSSSTLLSLFQ (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSLFQ

SEQ ID NO: 256095 - protein, 22 aa, Artificial Sequence
  Description of Artificial Sequence: Synthetic peptide
  Seed: AQSPLQIPVSPSSSSTLLSLFQ (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXLFQ

SEQ ID NO: 256096 - protein, 22 aa, Artificial Sequence
  Description of Artificial Sequence: Synthetic peptide
  Seed: AQSPLQIPVSPSSSSTLLSLFQ (MAGC1_HUMAN)
  Core: SSSSTLLSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSPXSSXTXLSXFQ

SEQ ID NO: 256097 - protein, 23 aa, Artificial Sequence
  Description of Artificial Sequence: Synthetic peptide
  Seed: AQSPLQIPVSPSSSSTLLSLFQS (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSLFQS

SEQ ID NO: 256098 - protein, 23 aa, Artificial Sequence
  Description of Artificial Sequence: Synthetic peptide
  Seed: AQSPLQIPVSPSSSSTLLSLFQS (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXLFQS

SEQ ID NO: 256099 - protein, 23 aa, Artificial Sequence
  Description of Artificial Sequence: Synthetic peptide
  Seed: AQSPLQIPVSPSSSSTLLSLFQS (MAGC1_HUMAN)
  Core: SSSSTLLSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSPXSSXTXLSXFQS

SEQ ID NO: 256100 - protein, 24 aa, Artificial Sequence
  Description of Artificial Sequence: Synthetic peptide
  Seed: AQSPLQIPVSPSSSSTLLSLFQSF (MAGC1_HUMAN)
  Core: LQIPVSPSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSPXQIXVXPSXSSTLLSLFQSF

SEQ ID NO: 256101 - protein, 24 aa, Artificial Sequence
  Description of Artificial Sequence: Synthetic peptide
  Seed: AQSPLQIPVSPSSSSTLLSLFQSF (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSLFQSF

SEQ ID NO: 256102 - protein, 24 aa, Artificial Sequence
  Description of Artificial Sequence: Synthetic peptide
  Seed: AQSPLQIPVSPSSSSTLLSLFQSF (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXLFQSF

SEQ ID NO: 256103 - protein, 24 aa, Artificial Sequence
  Description of Artificial Sequence: Synthetic peptide
  Seed: AQSPLQIPVSPSSSSTLLSLFQSF (MAGC1_HUMAN)
  Core: SSSSTLLSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSPXSSXTXLSXFQSF

SEQ ID NO: 256104 - protein, 25 aa, Artificial Sequence
  Description of Artificial Sequence: Synthetic peptide
  Seed: AQSPLQIPVSPSSSSTLLSLFQSFS (MAGC1_HUMAN)
  Core: LQIPVSPSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSPXQIXVXPSXSSTLLSLFQSFS

SEQ ID NO: 256105 - protein, 25 aa, Artificial Sequence
  Description of Artificial Sequence: Synthetic peptide
  Seed: AQSPLQIPVSPSSSSTLLSLFQSFS (MAGC1_HUMAN)
  Core: VSPSSSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPXSPXSXSTXLSLFQSFS

SEQ ID NO: 256106 - protein, 25 aa, Artificial Sequence
  Description of Artificial Sequence: Synthetic peptide
  Seed: AQSPLQIPVSPSSSSTLLSLFQSFS (MAGC1_HUMAN)
  Core: PSSSSTLLS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSXSSXSXLLXLFQSFS

SEQ ID NO: 256107 - protein, 25 aa, Artificial Sequence
  Description of Artificial Sequence: Synthetic peptide
  Seed: AQSPLQIPVSPSSSSTLLSLFQSFS (MAGC1_HUMAN)
  Core: SSSSTLLSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQIPVSPXSSXTXLSXFQSFS

SEQ ID NO: 256108 - protein, 15 aa, Artificial Sequence
  Description of Artificial Sequence: Synthetic peptide
  Seed: AQSPLQRPVSSFFSY (MAGC1_HUMAN)
  Core: LQRPVSSFF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSPXQRXVXSFXSY

SEQ ID NO: 256109 - protein, 15 aa, Artificial Sequence
  Description of Artificial Sequence: Synthetic peptide
  Seed: AQSPLQRPVSSFFSY (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXY

SEQ ID NO: 256110 - protein, 16 aa, Artificial Sequence
  Description of Artificial Sequence: Synthetic peptide
  Seed: AQSPLQRPVSSFFSYT (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYT

SEQ ID NO: 256111 - protein, 16 aa, Artificial Sequence
  Description of Artificial Sequence: Synthetic peptide
  Seed: AQSPLQRPVSSFFSYT (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYX

SEQ ID NO: 256112 - protein, 17 aa, Artificial Sequence
  Description of Artificial Sequence: Synthetic peptide
  Seed: AQSPLQRPVSSFFSYTL (MAGC1_HUMAN)
  Core: LQRPVSSFF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSPXQRXVXSFXSYTL

SEQ ID NO: 256113 - protein, 17 aa, Artificial Sequence
  Description of Artificial Sequence: Synthetic peptide
  Seed: AQSPLQRPVSSFFSYTL (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTL

SEQ ID NO: 256114 - protein, 17 aa, Artificial Sequence
  Description of Artificial Sequence: Synthetic peptide
  Seed: AQSPLQRPVSSFFSYTL (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXL

SEQ ID NO: 256115 - protein, 17 aa, Artificial Sequence
  Description of Artificial Sequence: Synthetic peptide
  Seed: AQSPLQRPVSSFFSYTL (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTX

SEQ ID NO: 256116 - protein, 18 aa, Artificial Sequence
  Description of Artificial Sequence: Synthetic peptide
  Seed: AQSPLQRPVSSFFSYTLA (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXLA

SEQ ID NO: 256117 - protein, 18 aa, Artificial Sequence
  Description of Artificial Sequence: Synthetic peptide
  Seed: AQSPLQRPVSSFFSYTLA (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXA

SEQ ID NO: 256118 - protein, 19 aa, Artificial Sequence
  Description of Artificial Sequence: Synthetic peptide
  Seed: AQSPLQRPVSSFFSYTLAS (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLAS

SEQ ID NO: 256119 - protein, 19 aa, Artificial Sequence
  Description of Artificial Sequence: Synthetic peptide
  Seed: AQSPLQRPVSSFFSYTLAS (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXLAS

SEQ ID NO: 256120 - protein, 19 aa, Artificial Sequence
  Description of Artificial Sequence: Synthetic peptide
  Seed: AQSPLQRPVSSFFSYTLAS (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXAS

SEQ ID NO: 256121 - protein, 20 aa, Artificial Sequence
  Description of Artificial Sequence: Synthetic peptide
  Seed: AQSPLQRPVSSFFSYTLASL (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASL

SEQ ID NO: 256122 - protein, 20 aa, Artificial Sequence
  Description of Artificial Sequence: Synthetic peptide
  Seed: AQSPLQRPVSSFFSYTLASL (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXLASL

SEQ ID NO: 256123 - protein, 20 aa, Artificial Sequence
  Description of Artificial Sequence: Synthetic peptide
  Seed: AQSPLQRPVSSFFSYTLASL (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASL

SEQ ID NO: 256124 - protein, 20 aa, Artificial Sequence
  Description of Artificial Sequence: Synthetic peptide
  Seed: AQSPLQRPVSSFFSYTLASL (MAGC1_HUMAN)
  Core: FFSYTLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSXFSXTXASX

SEQ ID NO: 256125 - protein, 21 aa, Artificial Sequence
  Description of Artificial Sequence: Synthetic peptide
  Seed: AQSPLQRPVSSFFSYTLASLL (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASLL

SEQ ID NO: 256126 - protein, 21 aa, Artificial Sequence
  Description of Artificial Sequence: Synthetic peptide
  Seed: AQSPLQRPVSSFFSYTLASLL (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXLASLL

SEQ ID NO: 256127 - protein, 21 aa, Artificial Sequence
  Description of Artificial Sequence: Synthetic peptide
  Seed: AQSPLQRPVSSFFSYTLASLL (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASLL

SEQ ID NO: 256128 - protein, 21 aa, Artificial Sequence
  Description of Artificial Sequence: Synthetic peptide
  Seed: AQSPLQRPVSSFFSYTLASLL (MAGC1_HUMAN)
  Core: FFSYTLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSXFSXTXASXL

SEQ ID NO: 256129 - protein, 21 aa, Artificial Sequence
  Description of Artificial Sequence: Synthetic peptide
  Seed: AQSPLQRPVSSFFSYTLASLL (MAGC1_HUMAN)
  Core: FSYTLASLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFXSYXLXSLX

SEQ ID NO: 256130 - protein, 22 aa, Artificial Sequence
  Description of Artificial Sequence: Synthetic peptide
  Seed: AQSPLQRPVSSFFSYTLASLLQ (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASLLQ

SEQ ID NO: 256131 - protein, 22 aa, Artificial Sequence
  Description of Artificial Sequence: Synthetic peptide
  Seed: AQSPLQRPVSSFFSYTLASLLQ (MAGC1_HUMAN)
  Core: PVSSFFSYT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRXVSXFXSYXLASLLQ

SEQ ID NO: 256132 - protein, 22 aa, Artificial Sequence
  Description of Artificial Sequence: Synthetic peptide
  Seed: AQSPLQRPVSSFFSYTLASLLQ (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASLLQ

SEQ ID NO: 256133 - protein, 22 aa, Artificial Sequence
  Description of Artificial Sequence: Synthetic peptide
  Seed: AQSPLQRPVSSFFSYTLASLLQ (MAGC1_HUMAN)
  Core: FFSYTLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSXFSXTXASXLQ

SEQ ID NO: 256134 - protein, 22 aa, Artificial Sequence
  Description of Artificial Sequence: Synthetic peptide
  Seed: AQSPLQRPVSSFFSYTLASLLQ (MAGC1_HUMAN)
  Core: FSYTLASLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFXSYXLXSLXQ

SEQ ID NO: 256135 - protein, 23 aa, Artificial Sequence
  Description of Artificial Sequence: Synthetic peptide
  Seed: AQSPLQRPVSSFFSYTLASLLQS (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASLLQS

SEQ ID NO: 256136 - protein, 23 aa, Artificial Sequence
  Description of Artificial Sequence: Synthetic peptide
  Seed: AQSPLQRPVSSFFSYTLASLLQS (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASLLQS

SEQ ID NO: 256137 - protein, 23 aa, Artificial Sequence
  Description of Artificial Sequence: Synthetic peptide
  Seed: AQSPLQRPVSSFFSYTLASLLQS (MAGC1_HUMAN)
  Core: FFSYTLASL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSXFSXTXASXLQS

SEQ ID NO: 256138 - protein, 23 aa, Artificial Sequence
  Description of Artificial Sequence: Synthetic peptide
  Seed: AQSPLQRPVSSFFSYTLASLLQS (MAGC1_HUMAN)
  Core: FSYTLASLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFXSYXLXSLXQS

SEQ ID NO: 256139 - protein, 24 aa, Artificial Sequence
  Description of Artificial Sequence: Synthetic peptide
  Seed: AQSPLQRPVSSFFSYTLASLLQSS (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASLLQSS

SEQ ID NO: 256140 - protein, 24 aa, Artificial Sequence
  Description of Artificial Sequence: Synthetic peptide
  Seed: AQSPLQRPVSSFFSYTLASLLQSS (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASLLQSS

SEQ ID NO: 256141 - protein, 24 aa, Artificial Sequence
  Description of Artificial Sequence: Synthetic peptide
  Seed: AQSPLQRPVSSFFSYTLASLLQSS (MAGC1_HUMAN)
  Core: FSYTLASLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFXSYXLXSLXQSS

SEQ ID NO: 256142 - protein, 25 aa, Artificial Sequence
  Description of Artificial Sequence: Synthetic peptide
  Seed: AQSPLQRPVSSFFSYTLASLLQSSH (MAGC1_HUMAN)
  Core: QRPVSSFFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXRPXSXFFXYTLASLLQSSH

SEQ ID NO: 256143 - protein, 25 aa, Artificial Sequence
  Description of Artificial Sequence: Synthetic peptide
  Seed: AQSPLQRPVSSFFSYTLASLLQSSH (MAGC1_HUMAN)
  Core: VSSFFSYTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPXSSXFXYTXASLLQSSH

SEQ ID NO: 256144 - protein, 25 aa, Artificial Sequence
  Description of Artificial Sequence: Synthetic peptide
  Seed: AQSPLQRPVSSFFSYTLASLLQSSH (MAGC1_HUMAN)
  Core: FSYTLASLL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFXSYXLXSLXQSSH

SEQ ID NO: 256145 - protein, 25 aa, Artificial Sequence
  Description of Artificial Sequence: Synthetic peptide
  Seed: AQSPLQRPVSSFFSYTLASLLQSSH (MAGC1_HUMAN)
  Core: TLASLLQSS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQRPVSSFFSYXLAXLXQSXH

SEQ ID NO: 256146 - protein, 16 aa, Artificial Sequence
  Description of Artificial Sequence: Synthetic peptide
  Seed: AQSPLQSPVSSFPSST (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSX

SEQ ID NO: 256147 - protein, 17 aa, Artificial Sequence
  Description of Artificial Sequence: Synthetic peptide
  Seed: AQSPLQSPVSSFPSSTS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXS

SEQ ID NO: 256148 - protein, 18 aa, Artificial Sequence
  Description of Artificial Sequence: Synthetic peptide
  Seed: AQSPLQSPVSSFPSSTSS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSS

SEQ ID NO: 256149 - protein, 19 aa, Artificial Sequence
  Description of Artificial Sequence: Synthetic peptide
  Seed: AQSPLQSPVSSFPSSTSSS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSS

SEQ ID NO: 256150 - protein, 20 aa, Artificial Sequence
  Description of Artificial Sequence: Synthetic peptide
  Seed: AQSPLQSPVSSFPSSTSSSL (MAGC1_HUMAN)
  Core: QSPVSSFPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXSPXSXFPXSTSSSL

SEQ ID NO: 256151 - protein, 20 aa, Artificial Sequence
  Description of Artificial Sequence: Synthetic peptide
  Seed: AQSPLQSPVSSFPSSTSSSL (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSL

SEQ ID NO: 256152 - protein, 20 aa, Artificial Sequence
  Description of Artificial Sequence: Synthetic peptide
  Seed: AQSPLQSPVSSFPSSTSSSL (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSL

SEQ ID NO: 256153 - protein, 21 aa, Artificial Sequence
  Description of Artificial Sequence: Synthetic peptide
  Seed: AQSPLQSPVSSFPSSTSSSLS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSLS

SEQ ID NO: 256154 - protein, 21 aa, Artificial Sequence
  Description of Artificial Sequence: Synthetic peptide
  Seed: AQSPLQSPVSSFPSSTSSSLS (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSLS

SEQ ID NO: 256155 - protein, 22 aa, Artificial Sequence
  Description of Artificial Sequence: Synthetic peptide
  Seed: AQSPLQSPVSSFPSSTSSSLSQ (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSLSQ

SEQ ID NO: 256156 - protein, 22 aa, Artificial Sequence
  Description of Artificial Sequence: Synthetic peptide
  Seed: AQSPLQSPVSSFPSSTSSSLSQ (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSLSQ

SEQ ID NO: 256157 - protein, 23 aa, Artificial Sequence
  Description of Artificial Sequence: Synthetic peptide
  Seed: AQSPLQSPVSSFPSSTSSSLSQS (MAGC1_HUMAN)
  Core: QSPVSSFPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXSPXSXFPXSTSSSLSQS

SEQ ID NO: 256158 - protein, 23 aa, Artificial Sequence
  Description of Artificial Sequence: Synthetic peptide
  Seed: AQSPLQSPVSSFPSSTSSSLSQS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSLSQS

SEQ ID NO: 256159 - protein, 23 aa, Artificial Sequence
  Description of Artificial Sequence: Synthetic peptide
  Seed: AQSPLQSPVSSFPSSTSSSLSQS (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSLSQS

SEQ ID NO: 256160 - protein, 24 aa, Artificial Sequence
  Description of Artificial Sequence: Synthetic peptide
  Seed: AQSPLQSPVSSFPSSTSSSLSQSS (MAGC1_HUMAN)
  Core: QSPVSSFPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXSPXSXFPXSTSSSLSQSS

SEQ ID NO: 256161 - protein, 24 aa, Artificial Sequence
  Description of Artificial Sequence: Synthetic peptide
  Seed: AQSPLQSPVSSFPSSTSSSLSQSS (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSLSQSS

SEQ ID NO: 256162 - protein, 24 aa, Artificial Sequence
  Description of Artificial Sequence: Synthetic peptide
  Seed: AQSPLQSPVSSFPSSTSSSLSQSS (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSLSQSS

SEQ ID NO: 256163 - protein, 24 aa, Artificial Sequence
  Description of Artificial Sequence: Synthetic peptide
  Seed: AQSPLQSPVSSFPSSTSSSLSQSS (MAGC1_HUMAN)
  Core: PSSTSSSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPVSSFXSSXSXSLXQSS

SEQ ID NO: 256164 - protein, 25 aa, Artificial Sequence
  Description of Artificial Sequence: Synthetic peptide
  Seed: AQSPLQSPVSSFPSSTSSSLSQSSP (MAGC1_HUMAN)
  Core: QSPVSSFPS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLXSPXSXFPXSTSSSLSQSSP

SEQ ID NO: 256165 - protein, 25 aa, Artificial Sequence
  Description of Artificial Sequence: Synthetic peptide
  Seed: AQSPLQSPVSSFPSSTSSSLSQSSP (MAGC1_HUMAN)
  Core: PVSSFPSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSXVSXFXSSXSSSLSQSSP

SEQ ID NO: 256166 - protein, 25 aa, Artificial Sequence
  Description of Artificial Sequence: Synthetic peptide
  Seed: AQSPLQSPVSSFPSSTSSSLSQSSP (MAGC1_HUMAN)
  Core: VSSFPSSTS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPXSSXPXSTXSSLSQSSP

SEQ ID NO: 256167 - protein, 25 aa, Artificial Sequence
  Description of Artificial Sequence: Synthetic peptide
  Seed: AQSPLQSPVSSFPSSTSSSLSQSSP (MAGC1_HUMAN)
  Core: PSSTSSSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSPLQSPVSSFXSSXSXSLXQSSP

SEQ ID NO: 256168 - protein, 15 aa, Artificial Sequence
  Description of Artificial Sequence: Synthetic peptide
  Seed: AQSSLQIPVSPSFSS (MAGC1_HUMAN)
  Core: SLQIPVSPS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AQSXLQXPXSPXFSS

SEQ ID NO: 256169 - protein, 15 aa, Artificial Sequence
  Description of Artificial Sequence: Synthetic peptide
  Seed: AQSSLQIPVSPSFSS (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSS

SEQ ID NO: 256170 - protein, 15 aa, Artificial Sequence
  Description of Artificial Sequence: Synthetic peptide
  Seed: AQSSLQIPVSPSFSS (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXS

SEQ ID NO: 256171 - protein, 16 aa, Artificial Sequence
  Description of Artificial Sequence: Synthetic peptide
  Seed: AQSSLQIPVSPSFSST (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXST

SEQ ID NO: 256172 - protein, 17 aa, Artificial Sequence
  Description of Artificial Sequence: Synthetic peptide
  Seed: AQSSLQIPVSPSFSSTL (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTL

SEQ ID NO: 256173 - protein, 19 aa, Artificial Sequence
  Description of Artificial Sequence: Synthetic peptide
  Seed: AQSSLQIPVSPSFSSTLVS (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTLVS

SEQ ID NO: 256174 - protein, 19 aa, Artificial Sequence
  Description of Artificial Sequence: Synthetic peptide
  Seed: AQSSLQIPVSPSFSSTLVS (MAGC1_HUMAN)
  Core: VSPSFSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPXSPXFXSTXVS

SEQ ID NO: 256175 - protein, 20 aa, Artificial Sequence
  Description of Artificial Sequence: Synthetic peptide
  Seed: AQSSLQIPVSPSFSSTLVSL (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSL

SEQ ID NO: 256176 - protein, 20 aa, Artificial Sequence
  Description of Artificial Sequence: Synthetic peptide
  Seed: AQSSLQIPVSPSFSSTLVSL (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTLVSL

SEQ ID NO: 256177 - protein, 20 aa, Artificial Sequence
  Description of Artificial Sequence: Synthetic peptide
  Seed: AQSSLQIPVSPSFSSTLVSL (MAGC1_HUMAN)
  Core: PVSPSFSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIXVSXSXSSXLVSL

SEQ ID NO: 256178 - protein, 20 aa, Artificial Sequence
  Description of Artificial Sequence: Synthetic peptide
  Seed: AQSSLQIPVSPSFSSTLVSL (MAGC1_HUMAN)
  Core: VSPSFSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPXSPXFXSTXVSL

SEQ ID NO: 256179 - protein, 20 aa, Artificial Sequence
  Description of Artificial Sequence: Synthetic peptide
  Seed: AQSSLQIPVSPSFSSTLVSL (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXL

SEQ ID NO: 256180 - protein, 20 aa, Artificial Sequence
  Description of Artificial Sequence: Synthetic peptide
  Seed: AQSSLQIPVSPSFSSTLVSL (MAGC1_HUMAN)
  Core: SFSSTLVSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPXFSXTXVSX

SEQ ID NO: 256181 - protein, 21 aa, Artificial Sequence
  Description of Artificial Sequence: Synthetic peptide
  Seed: AQSSLQIPVSPSFSSTLVSLF (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSLF

SEQ ID NO: 256182 - protein, 21 aa, Artificial Sequence
  Description of Artificial Sequence: Synthetic peptide
  Seed: AQSSLQIPVSPSFSSTLVSLF (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTLVSLF

SEQ ID NO: 256183 - protein, 21 aa, Artificial Sequence
  Description of Artificial Sequence: Synthetic peptide
  Seed: AQSSLQIPVSPSFSSTLVSLF (MAGC1_HUMAN)
  Core: PVSPSFSST
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIXVSXSXSSXLVSLF

SEQ ID NO: 256184 - protein, 21 aa, Artificial Sequence
  Description of Artificial Sequence: Synthetic peptide
  Seed: AQSSLQIPVSPSFSSTLVSLF (MAGC1_HUMAN)
  Core: VSPSFSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPXSPXFXSTXVSLF

SEQ ID NO: 256185 - protein, 21 aa, Artificial Sequence
  Description of Artificial Sequence: Synthetic peptide
  Seed: AQSSLQIPVSPSFSSTLVSLF (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXLF

SEQ ID NO: 256186 - protein, 21 aa, Artificial Sequence
  Description of Artificial Sequence: Synthetic peptide
  Seed: AQSSLQIPVSPSFSSTLVSLF (MAGC1_HUMAN)
  Core: SFSSTLVSL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPXFSXTXVSXF

SEQ ID NO: 256187 - protein, 21 aa, Artificial Sequence
  Description of Artificial Sequence: Synthetic peptide
  Seed: AQSSLQIPVSPSFSSTLVSLF (MAGC1_HUMAN)
  Core: FSSTLVSLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPSXSSXLXSLX

SEQ ID NO: 256188 - protein, 22 aa, Artificial Sequence
  Description of Artificial Sequence: Synthetic peptide
  Seed: AQSSLQIPVSPSFSSTLVSLFQ (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSLFQ

SEQ ID NO: 256189 - protein, 22 aa, Artificial Sequence
  Description of Artificial Sequence: Synthetic peptide
  Seed: AQSSLQIPVSPSFSSTLVSLFQ (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTLVSLFQ

SEQ ID NO: 256190 - protein, 22 aa, Artificial Sequence
  Description of Artificial Sequence: Synthetic peptide
  Seed: AQSSLQIPVSPSFSSTLVSLFQ (MAGC1_HUMAN)
  Core: VSPSFSSTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPXSPXFXSTXVSLFQ

SEQ ID NO: 256191 - protein, 22 aa, Artificial Sequence
  Description of Artificial Sequence: Synthetic peptide
  Seed: AQSSLQIPVSPSFSSTLVSLFQ (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXLFQ

SEQ ID NO: 256192 - protein, 22 aa, Artificial Sequence
  Description of Artificial Sequence: Synthetic peptide
  Seed: AQSSLQIPVSPSFSSTLVSLFQ (MAGC1_HUMAN)
  Core: FSSTLVSLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPSXSSXLXSLXQ

SEQ ID NO: 256193 - protein, 23 aa, Artificial Sequence
  Description of Artificial Sequence: Synthetic peptide
  Seed: AQSSLQIPVSPSFSSTLVSLFQS (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSLFQS

SEQ ID NO: 256194 - protein, 23 aa, Artificial Sequence
  Description of Artificial Sequence: Synthetic peptide
  Seed: AQSSLQIPVSPSFSSTLVSLFQS (MAGC1_HUMAN)
  Core: QIPVSPSFS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLXIPXSXSFXSTLVSLFQS

SEQ ID NO: 256195 - protein, 23 aa, Artificial Sequence
  Description of Artificial Sequence: Synthetic peptide
  Seed: AQSSLQIPVSPSFSSTLVSLFQS (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXLFQS

SEQ ID NO: 256196 - protein, 23 aa, Artificial Sequence
  Description of Artificial Sequence: Synthetic peptide
  Seed: AQSSLQIPVSPSFSSTLVSLFQS (MAGC1_HUMAN)
  Core: FSSTLVSLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPSXSSXLXSLXQS

SEQ ID NO: 256197 - protein, 24 aa, Artificial Sequence
  Description of Artificial Sequence: Synthetic peptide
  Seed: AQSSLQIPVSPSFSSTLVSLFQSS (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSLFQSS

SEQ ID NO: 256198 - protein, 24 aa, Artificial Sequence
  Description of Artificial Sequence: Synthetic peptide
  Seed: AQSSLQIPVSPSFSSTLVSLFQSS (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXLFQSS

SEQ ID NO: 256199 - protein, 24 aa, Artificial Sequence
  Description of Artificial Sequence: Synthetic peptide
  Seed: AQSSLQIPVSPSFSSTLVSLFQSS (MAGC1_HUMAN)
  Core: FSSTLVSLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPSXSSXLXSLXQSS

SEQ ID NO: 256200 - protein, 25 aa, Artificial Sequence
  Description of Artificial Sequence: Synthetic peptide
  Seed: AQSSLQIPVSPSFSSTLVSLFQSSP (MAGC1_HUMAN)
  Core: LQIPVSPSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSSXQIXVXPSXSSTLVSLFQSSP

SEQ ID NO: 256201 - protein, 25 aa, Artificial Sequence
  Description of Artificial Sequence: Synthetic peptide
  Seed: AQSSLQIPVSPSFSSTLVSLFQSSP (MAGC1_HUMAN)
  Core: PSFSSTLVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSXSFXSXLVXLFQSSP

SEQ ID NO: 256202 - protein, 25 aa, Artificial Sequence
  Description of Artificial Sequence: Synthetic peptide
  Seed: AQSSLQIPVSPSFSSTLVSLFQSSP (MAGC1_HUMAN)
  Core: FSSTLVSLF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AQSSLQIPVSPSXSSXLXSLXQSSP

SEQ ID NO: 256203 - protein, 15 aa, Artificial Sequence
  Description of Artificial Sequence: Synthetic peptide
  Seed: AQSTFEGFPQSPLQI (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQI

SEQ ID NO: 256204 - protein, 16 aa, Artificial Sequence
  Description of Artificial Sequence: Synthetic peptide
  Seed: AQSTFEGFPQSPLQIP (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIP

SEQ ID NO: 256205 - protein, 17 aa, Artificial Sequence
  Description of Artificial Sequence: Synthetic peptide
  Seed: AQSTFEGFPQSPLQIPG (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPG

SEQ ID NO: 256206 - protein, 19 aa, Artificial Sequence
  Description of Artificial Sequence: Synthetic peptide
  Seed: AQSTFEGFPQSPLQIPGSP (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSP

SEQ ID NO: 256207 - protein, 20 aa, Artificial Sequence
  Description of Artificial Sequence: Synthetic peptide
  Seed: AQSTFEGFPQSPLQIPGSPS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPS

SEQ ID NO: 256208 - protein, 21 aa, Artificial Sequence
  Description of Artificial Sequence: Synthetic peptide
  Seed: AQSTFEGFPQSPLQIPGSPSF (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPSF

SEQ ID NO: 256209 - protein, 22 aa, Artificial Sequence
  Description of Artificial Sequence: Synthetic peptide
  Seed: AQSTFEGFPQSPLQIPGSPSFS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPSFS

SEQ ID NO: 256210 - protein, 23 aa, Artificial Sequence
  Description of Artificial Sequence: Synthetic peptide
  Seed: AQSTFEGFPQSPLQIPGSPSFSS (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPSFSS

SEQ ID NO: 256211 - protein, 24 aa, Artificial Sequence
  Description of Artificial Sequence: Synthetic peptide
  Seed: AQSTFEGFPQSPLQIPGSPSFSST (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPSFSST

SEQ ID NO: 256212 - protein, 25 aa, Artificial Sequence
  Description of Artificial Sequence: Synthetic peptide
  Seed: AQSTFEGFPQSPLQIPGSPSFSSTL (MAGC1_HUMAN)
  Core: FEGFPQSPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AQSTXEGXPXSPXQIPGSPSFSSTL

SEQ ID NO: 256213 - protein, 25 aa, Artificial Sequence
  Description of Artificial Sequence: Synthetic peptide
  Seed: AQSTFEGFPQSPLQIPGSPSFSSTL (MAGC1_HUMAN)
  Core: QIPGSPSFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
AQSTFEGFPQSPLXIPXSXSFXSTL

SEQ ID NO: 256214 - protein, 13 aa, Artificial Sequence
  Description of Artificial Sequence: Synthetic peptide
  Seed: AREFIEILFGISL (MAGC1_HUMAN)
  Core: FIEILFGIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AREXIEXLXGIXL

SEQ ID NO: 256215 - protein, 14 aa, Artificial Sequence
  Description of Artificial Sequence: Synthetic peptide
  Seed: AREFIEILFGISLR (MAGC1_HUMAN)
  Core: FIEILFGIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AREXIEXLXGIXLR

SEQ ID NO: 256216 - protein, 14 aa, Artificial Sequence
  Description of Artificial Sequence: Synthetic peptide
  Seed: AREFIEILFGISLR (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXR

SEQ ID NO: 256217 - protein, 15 aa, Artificial Sequence
  Description of Artificial Sequence: Synthetic peptide
  Seed: AREFIEILFGISLRE (MAGC1_HUMAN)
  Core: FIEILFGIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AREXIEXLXGIXLRE

SEQ ID NO: 256218 - protein, 15 aa, Artificial Sequence
  Description of Artificial Sequence: Synthetic peptide
  Seed: AREFIEILFGISLRE (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXRE

SEQ ID NO: 256219 - protein, 16 aa, Artificial Sequence
  Description of Artificial Sequence: Synthetic peptide
  Seed: AREFIEILFGISLREV (MAGC1_HUMAN)
  Core: FIEILFGIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AREXIEXLXGIXLREV

SEQ ID NO: 256220 - protein, 16 aa, Artificial Sequence
  Description of Artificial Sequence: Synthetic peptide
  Seed: AREFIEILFGISLREV (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREV

SEQ ID NO: 256221 - protein, 16 aa, Artificial Sequence
  Description of Artificial Sequence: Synthetic peptide
  Seed: AREFIEILFGISLREV (MAGC1_HUMAN)
  Core: EILFGISLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AREFIXILXGXSLXEV

SEQ ID NO: 256222 - protein, 16 aa, Artificial Sequence
  Description of Artificial Sequence: Synthetic peptide
  Seed: AREFIEILFGISLREV (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXV

SEQ ID NO: 256223 - protein, 16 aa, Artificial Sequence
  Description of Artificial Sequence: Synthetic peptide
  Seed: AREFIEILFGISLREV (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREX

SEQ ID NO: 256224 - protein, 17 aa, Artificial Sequence
  Description of Artificial Sequence: Synthetic peptide
  Seed: AREFIEILFGISLREVD (MAGC1_HUMAN)
  Core: FIEILFGIS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
AREXIEXLXGIXLREVD

SEQ ID NO: 256225 - protein, 17 aa, Artificial Sequence
  Description of Artificial Sequence: Synthetic peptide
  Seed: AREFIEILFGISLREVD (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVD

SEQ ID NO: 256226 - protein, 17 aa, Artificial Sequence
  Description of Artificial Sequence: Synthetic peptide
  Seed: AREFIEILFGISLREVD (MAGC1_HUMAN)
  Core: EILFGISLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
AREFIXILXGXSLXEVD

SEQ ID NO: 256227 - protein, 17 aa, Artificial Sequence
  Description of Artificial Sequence: Synthetic peptide
  Seed: AREFIEILFGISLREVD (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVD

SEQ ID NO: 256228 - protein, 17 aa, Artificial Sequence
  Description of Artificial Sequence: Synthetic peptide
  Seed: AREFIEILFGISLREVD (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXD

SEQ ID NO: 256229 - protein, 17 aa, Artificial Sequence
  Description of Artificial Sequence: Synthetic peptide
  Seed: AREFIEILFGISLREVD (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVX

SEQ ID NO: 256230 - protein, 18 aa, Artificial Sequence
  Description of Artificial Sequence: Synthetic peptide
  Seed: AREFIEILFGISLREVDP (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDP

SEQ ID NO: 256231 - protein, 18 aa, Artificial Sequence
  Description of Artificial Sequence: Synthetic peptide
  Seed: AREFIEILFGISLREVDP (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDP

SEQ ID NO: 256232 - protein, 19 aa, Artificial Sequence
  Description of Artificial Sequence: Synthetic peptide
  Seed: AREFIEILFGISLREVDPD (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPD

SEQ ID NO: 256233 - protein, 19 aa, Artificial Sequence
  Description of Artificial Sequence: Synthetic peptide
  Seed: AREFIEILFGISLREVDPD (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPD

SEQ ID NO: 256234 - protein, 19 aa, Artificial Sequence
  Description of Artificial Sequence: Synthetic peptide
  Seed: AREFIEILFGISLREVDPD (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPD

SEQ ID NO: 256235 - protein, 19 aa, Artificial Sequence
  Description of Artificial Sequence: Synthetic peptide
  Seed: AREFIEILFGISLREVDPD (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPD

SEQ ID NO: 256236 - protein, 20 aa, Artificial Sequence
  Description of Artificial Sequence: Synthetic peptide
  Seed: AREFIEILFGISLREVDPDD (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDD

SEQ ID NO: 256237 - protein, 20 aa, Artificial Sequence
  Description of Artificial Sequence: Synthetic peptide
  Seed: AREFIEILFGISLREVDPDD (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPDD

SEQ ID NO: 256238 - protein, 20 aa, Artificial Sequence
  Description of Artificial Sequence: Synthetic peptide
  Seed: AREFIEILFGISLREVDPDD (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDD

SEQ ID NO: 256239 - protein, 20 aa, Artificial Sequence
  Description of Artificial Sequence: Synthetic peptide
  Seed: AREFIEILFGISLREVDPDD (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDD

SEQ ID NO: 256240 - protein, 21 aa, Artificial Sequence
  Description of Artificial Sequence: Synthetic peptide
  Seed: AREFIEILFGISLREVDPDDS (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDDS

SEQ ID NO: 256241 - protein, 21 aa, Artificial Sequence
  Description of Artificial Sequence: Synthetic peptide
  Seed: AREFIEILFGISLREVDPDDS (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPDDS

SEQ ID NO: 256242 - protein, 21 aa, Artificial Sequence
  Description of Artificial Sequence: Synthetic peptide
  Seed: AREFIEILFGISLREVDPDDS (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDDS

SEQ ID NO: 256243 - protein, 21 aa, Artificial Sequence
  Description of Artificial Sequence: Synthetic peptide
  Seed: AREFIEILFGISLREVDPDDS (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDDS

SEQ ID NO: 256244 - protein, 22 aa, Artificial Sequence
  Description of Artificial Sequence: Synthetic peptide
  Seed: AREFIEILFGISLREVDPDDSY (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDDSY

SEQ ID NO: 256245 - protein, 22 aa, Artificial Sequence
  Description of Artificial Sequence: Synthetic peptide
  Seed: AREFIEILFGISLREVDPDDSY (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPDDSY

SEQ ID NO: 256246 - protein, 22 aa, Artificial Sequence
  Description of Artificial Sequence: Synthetic peptide
  Seed: AREFIEILFGISLREVDPDDSY (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDDSY

SEQ ID NO: 256247 - protein, 22 aa, Artificial Sequence
  Description of Artificial Sequence: Synthetic peptide
  Seed: AREFIEILFGISLREVDPDDSY (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDDSY

SEQ ID NO: 256248 - protein, 23 aa, Artificial Sequence
  Description of Artificial Sequence: Synthetic peptide
  Seed: AREFIEILFGISLREVDPDDSYV (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDDSYV

SEQ ID NO: 256249 - protein, 23 aa, Artificial Sequence
  Description of Artificial Sequence: Synthetic peptide
  Seed: AREFIEILFGISLREVDPDDSYV (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPDDSYV

SEQ ID NO: 256250 - protein, 23 aa, Artificial Sequence
  Description of Artificial Sequence: Synthetic peptide
  Seed: AREFIEILFGISLREVDPDDSYV (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDDSYV

SEQ ID NO: 256251 - protein, 23 aa, Artificial Sequence
  Description of Artificial Sequence: Synthetic peptide
  Seed: AREFIEILFGISLREVDPDDSYV (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDDSYV

SEQ ID NO: 256252 - protein, 24 aa, Artificial Sequence
  Description of Artificial Sequence: Synthetic peptide
  Seed: AREFIEILFGISLREVDPDDSYVF (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDDSYVF

SEQ ID NO: 256253 - protein, 24 aa, Artificial Sequence
  Description of Artificial Sequence: Synthetic peptide
  Seed: AREFIEILFGISLREVDPDDSYVF (MAGC1_HUMAN)
  Core: ILFGISLRE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEXLFXIXLRXVDPDDSYVF

SEQ ID NO: 256254 - protein, 24 aa, Artificial Sequence
  Description of Artificial Sequence: Synthetic peptide
  Seed: AREFIEILFGISLREVDPDDSYVF (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDDSYVF

SEQ ID NO: 256255 - protein, 24 aa, Artificial Sequence
  Description of Artificial Sequence: Synthetic peptide
  Seed: AREFIEILFGISLREVDPDDSYVF (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDDSYVF

SEQ ID NO: 256256 - protein, 24 aa, Artificial Sequence
  Description of Artificial Sequence: Synthetic peptide
  Seed: AREFIEILFGISLREVDPDDSYVF (MAGC1_HUMAN)
  Core: LREVDPDDS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILFGISXREXDXDDXYVF

SEQ ID NO: 256257 - protein, 25 aa, Artificial Sequence
  Description of Artificial Sequence: Synthetic peptide
  Seed: AREFIEILFGISLREVDPDDSYVFV (MAGC1_HUMAN)
  Core: IEILFGISL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
AREFXEIXFXISXREVDPDDSYVFV

SEQ ID NO: 256258 - protein, 25 aa, Artificial Sequence
  Description of Artificial Sequence: Synthetic peptide
  Seed: AREFIEILFGISLREVDPDDSYVFV (MAGC1_HUMAN)
  Core: LFGISLREV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEIXFGXSXREXDPDDSYVFV

SEQ ID NO: 256259 - protein, 25 aa, Artificial Sequence
  Description of Artificial Sequence: Synthetic peptide
  Seed: AREFIEILFGISLREVDPDDSYVFV (MAGC1_HUMAN)
  Core: FGISLREVD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILXGIXLXEVXPDDSYVFV

SEQ ID NO: 256260 - protein, 25 aa, Artificial Sequence
  Description of Artificial Sequence: Synthetic peptide
  Seed: AREFIEILFGISLREVDPDDSYVFV (MAGC1_HUMAN)
  Core: ISLREVDPD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILFGXSLXEXDPXDSYVFV

SEQ ID NO: 256261 - protein, 25 aa, Artificial Sequence
  Description of Artificial Sequence: Synthetic peptide
  Seed: AREFIEILFGISLREVDPDDSYVFV (MAGC1_HUMAN)
  Core: LREVDPDDS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
AREFIEILFGISXREXDXDDXYVFV

SEQ ID NO: 256262 - protein, 13 aa, Artificial Sequence
  Description of Artificial Sequence: Synthetic peptide
  Seed: ARFLLLKYQVKQP (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQP

SEQ ID NO: 256263 - protein, 14 aa, Artificial Sequence
  Description of Artificial Sequence: Synthetic peptide
  Seed: ARFLLLKYQVKQPI (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPI

SEQ ID NO: 256264 - protein, 14 aa, Artificial Sequence
  Description of Artificial Sequence: Synthetic peptide
  Seed: ARFLLLKYQVKQPI (MAGC1_HUMAN)
  Core: LLLKYQVKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ARFXLLXYXVKXPI

SEQ ID NO: 256265 - protein, 14 aa, Artificial Sequence
  Description of Artificial Sequence: Synthetic peptide
  Seed: ARFLLLKYQVKQPI (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXI

SEQ ID NO: 256266 - protein, 14 aa, Artificial Sequence
  Description of Artificial Sequence: Synthetic peptide
  Seed: ARFLLLKYQVKQPI (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPX

SEQ ID NO: 256267 - protein, 15 aa, Artificial Sequence
  Description of Artificial Sequence: Synthetic peptide
  Seed: ARFLLLKYQVKQPIT (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPIT

SEQ ID NO: 256268 - protein, 15 aa, Artificial Sequence
  Description of Artificial Sequence: Synthetic peptide
  Seed: ARFLLLKYQVKQPIT (MAGC1_HUMAN)
  Core: LLLKYQVKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ARFXLLXYXVKXPIT

SEQ ID NO: 256269 - protein, 15 aa, Artificial Sequence
  Description of Artificial Sequence: Synthetic peptide
  Seed: ARFLLLKYQVKQPIT (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXIT

SEQ ID NO: 256270 - protein, 15 aa, Artificial Sequence
  Description of Artificial Sequence: Synthetic peptide
  Seed: ARFLLLKYQVKQPIT (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXT

SEQ ID NO: 256271 - protein, 16 aa, Artificial Sequence
  Description of Artificial Sequence: Synthetic peptide
  Seed: ARFLLLKYQVKQPITK (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITK

SEQ ID NO: 256272 - protein, 16 aa, Artificial Sequence
  Description of Artificial Sequence: Synthetic peptide
  Seed: ARFLLLKYQVKQPITK (MAGC1_HUMAN)
  Core: LLLKYQVKQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ARFXLLXYXVKXPITK

SEQ ID NO: 256273 - protein, 16 aa, Artificial Sequence
  Description of Artificial Sequence: Synthetic peptide
  Seed: ARFLLLKYQVKQPITK (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITK

SEQ ID NO: 256274 - protein, 16 aa, Artificial Sequence
  Description of Artificial Sequence: Synthetic peptide
  Seed: ARFLLLKYQVKQPITK (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTK

SEQ ID NO: 256275 - protein, 17 aa, Artificial Sequence
  Description of Artificial Sequence: Synthetic peptide
  Seed: ARFLLLKYQVKQPITKA (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKA

SEQ ID NO: 256276 - protein, 17 aa, Artificial Sequence
  Description of Artificial Sequence: Synthetic peptide
  Seed: ARFLLLKYQVKQPITKA (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKA

SEQ ID NO: 256277 - protein, 17 aa, Artificial Sequence
  Description of Artificial Sequence: Synthetic peptide
  Seed: ARFLLLKYQVKQPITKA (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKA

SEQ ID NO: 256278 - protein, 17 aa, Artificial Sequence
  Description of Artificial Sequence: Synthetic peptide
  Seed: ARFLLLKYQVKQPITKA (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXA

SEQ ID NO: 256279 - protein, 18 aa, Artificial Sequence
  Description of Artificial Sequence: Synthetic peptide
  Seed: ARFLLLKYQVKQPITKAE (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAE

SEQ ID NO: 256280 - protein, 18 aa, Artificial Sequence
  Description of Artificial Sequence: Synthetic peptide
  Seed: ARFLLLKYQVKQPITKAE (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAE

SEQ ID NO: 256281 - protein, 18 aa, Artificial Sequence
  Description of Artificial Sequence: Synthetic peptide
  Seed: ARFLLLKYQVKQPITKAE (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAE

SEQ ID NO: 256282 - protein, 18 aa, Artificial Sequence
  Description of Artificial Sequence: Synthetic peptide
  Seed: ARFLLLKYQVKQPITKAE (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAE

SEQ ID NO: 256283 - protein, 19 aa, Artificial Sequence
  Description of Artificial Sequence: Synthetic peptide
  Seed: ARFLLLKYQVKQPITKAEM (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEM

SEQ ID NO: 256284 - protein, 19 aa, Artificial Sequence
  Description of Artificial Sequence: Synthetic peptide
  Seed: ARFLLLKYQVKQPITKAEM (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEM

SEQ ID NO: 256285 - protein, 19 aa, Artificial Sequence
  Description of Artificial Sequence: Synthetic peptide
  Seed: ARFLLLKYQVKQPITKAEM (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEM

SEQ ID NO: 256286 - protein, 19 aa, Artificial Sequence
  Description of Artificial Sequence: Synthetic peptide
  Seed: ARFLLLKYQVKQPITKAEM (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEM

SEQ ID NO: 256287 - protein, 20 aa, Artificial Sequence
  Description of Artificial Sequence: Synthetic peptide
  Seed: ARFLLLKYQVKQPITKAEML (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEML

SEQ ID NO: 256288 - protein, 20 aa, Artificial Sequence
  Description of Artificial Sequence: Synthetic peptide
  Seed: ARFLLLKYQVKQPITKAEML (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEML

SEQ ID NO: 256289 - protein, 20 aa, Artificial Sequence
  Description of Artificial Sequence: Synthetic peptide
  Seed: ARFLLLKYQVKQPITKAEML (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEML

SEQ ID NO: 256290 - protein, 20 aa, Artificial Sequence
  Description of Artificial Sequence: Synthetic peptide
  Seed: ARFLLLKYQVKQPITKAEML (MAGC1_HUMAN)
  Core: KYQVKQPIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLXYQXKXPIXKAEML

SEQ ID NO: 256291 - protein, 20 aa, Artificial Sequence
  Description of Artificial Sequence: Synthetic peptide
  Seed: ARFLLLKYQVKQPITKAEML (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEML

SEQ ID NO: 256292 - protein, 21 aa, Artificial Sequence
  Description of Artificial Sequence: Synthetic peptide
  Seed: ARFLLLKYQVKQPITKAEMLT (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEMLT

SEQ ID NO: 256293 - protein, 21 aa, Artificial Sequence
  Description of Artificial Sequence: Synthetic peptide
  Seed: ARFLLLKYQVKQPITKAEMLT (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEMLT

SEQ ID NO: 256294 - protein, 21 aa, Artificial Sequence
  Description of Artificial Sequence: Synthetic peptide
  Seed: ARFLLLKYQVKQPITKAEMLT (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEMLT

SEQ ID NO: 256295 - protein, 21 aa, Artificial Sequence
  Description of Artificial Sequence: Synthetic peptide
  Seed: ARFLLLKYQVKQPITKAEMLT (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEMLT

SEQ ID NO: 256296 - protein, 22 aa, Artificial Sequence
  Description of Artificial Sequence: Synthetic peptide
  Seed: ARFLLLKYQVKQPITKAEMLTN (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEMLTN

SEQ ID NO: 256297 - protein, 22 aa, Artificial Sequence
  Description of Artificial Sequence: Synthetic peptide
  Seed: ARFLLLKYQVKQPITKAEMLTN (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEMLTN

SEQ ID NO: 256298 - protein, 22 aa, Artificial Sequence
  Description of Artificial Sequence: Synthetic peptide
  Seed: ARFLLLKYQVKQPITKAEMLTN (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEMLTN

SEQ ID NO: 256299 - protein, 22 aa, Artificial Sequence
  Description of Artificial Sequence: Synthetic peptide
  Seed: ARFLLLKYQVKQPITKAEMLTN (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEMLTN

SEQ ID NO: 256300 - protein, 22 aa, Artificial Sequence
  Description of Artificial Sequence: Synthetic peptide
  Seed: ARFLLLKYQVKQPITKAEMLTN (MAGC1_HUMAN)
  Core: KQPITKAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVXQPXTXAEXLTN

SEQ ID NO: 256301 - protein, 22 aa, Artificial Sequence
  Description of Artificial Sequence: Synthetic peptide
  Seed: ARFLLLKYQVKQPITKAEMLTN (MAGC1_HUMAN)
  Core: ITKAEMLTN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVKQPXTKXEXLTX

SEQ ID NO: 256302 - protein, 23 aa, Artificial Sequence
  Description of Artificial Sequence: Synthetic peptide
  Seed: ARFLLLKYQVKQPITKAEMLTNV (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEMLTNV

SEQ ID NO: 256303 - protein, 23 aa, Artificial Sequence
  Description of Artificial Sequence: Synthetic peptide
  Seed: ARFLLLKYQVKQPITKAEMLTNV (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEMLTNV

SEQ ID NO: 256304 - protein, 23 aa, Artificial Sequence
  Description of Artificial Sequence: Synthetic peptide
  Seed: ARFLLLKYQVKQPITKAEMLTNV (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEMLTNV

SEQ ID NO: 256305 - protein, 23 aa, Artificial Sequence
  Description of Artificial Sequence: Synthetic peptide
  Seed: ARFLLLKYQVKQPITKAEMLTNV (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEMLTNV

SEQ ID NO: 256306 - protein, 23 aa, Artificial Sequence
  Description of Artificial Sequence: Synthetic peptide
  Seed: ARFLLLKYQVKQPITKAEMLTNV (MAGC1_HUMAN)
  Core: KQPITKAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVXQPXTXAEXLTNV

SEQ ID NO: 256307 - protein, 23 aa, Artificial Sequence
  Description of Artificial Sequence: Synthetic peptide
  Seed: ARFLLLKYQVKQPITKAEMLTNV (MAGC1_HUMAN)
  Core: ITKAEMLTN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVKQPXTKXEXLTXV

SEQ ID NO: 256308 - protein, 24 aa, Artificial Sequence
  Description of Artificial Sequence: Synthetic peptide
  Seed: ARFLLLKYQVKQPITKAEMLTNVI (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEMLTNVI

SEQ ID NO: 256309 - protein, 24 aa, Artificial Sequence
  Description of Artificial Sequence: Synthetic peptide
  Seed: ARFLLLKYQVKQPITKAEMLTNVI (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEMLTNVI

SEQ ID NO: 256310 - protein, 24 aa, Artificial Sequence
  Description of Artificial Sequence: Synthetic peptide
  Seed: ARFLLLKYQVKQPITKAEMLTNVI (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEMLTNVI

SEQ ID NO: 256311 - protein, 24 aa, Artificial Sequence
  Description of Artificial Sequence: Synthetic peptide
  Seed: ARFLLLKYQVKQPITKAEMLTNVI (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEMLTNVI

SEQ ID NO: 256312 - protein, 24 aa, Artificial Sequence
  Description of Artificial Sequence: Synthetic peptide
  Seed: ARFLLLKYQVKQPITKAEMLTNVI (MAGC1_HUMAN)
  Core: KQPITKAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVXQPXTXAEXLTNVI

SEQ ID NO: 256313 - protein, 24 aa, Artificial Sequence
  Description of Artificial Sequence: Synthetic peptide
  Seed: ARFLLLKYQVKQPITKAEMLTNVI (MAGC1_HUMAN)
  Core: ITKAEMLTN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVKQPXTKXEXLTXVI

SEQ ID NO: 256314 - protein, 25 aa, Artificial Sequence
  Description of Artificial Sequence: Synthetic peptide
  Seed: ARFLLLKYQVKQPITKAEMLTNVIS (MAGC1_HUMAN)
  Core: FLLLKYQVK
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ARXLLXKXQVXQPITKAEMLTNVIS

SEQ ID NO: 256315 - protein, 25 aa, Artificial Sequence
  Description of Artificial Sequence: Synthetic peptide
  Seed: ARFLLLKYQVKQPITKAEMLTNVIS (MAGC1_HUMAN)
  Core: LLKYQVKQP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ARFLXLKXQXKQXITKAEMLTNVIS

SEQ ID NO: 256316 - protein, 25 aa, Artificial Sequence
  Description of Artificial Sequence: Synthetic peptide
  Seed: ARFLLLKYQVKQPITKAEMLTNVIS (MAGC1_HUMAN)
  Core: LKYQVKQPI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLXKYXVXQPXTKAEMLTNVIS

SEQ ID NO: 256317 - protein, 25 aa, Artificial Sequence
  Description of Artificial Sequence: Synthetic peptide
  Seed: ARFLLLKYQVKQPITKAEMLTNVIS (MAGC1_HUMAN)
  Core: YQVKQPITK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKXQVXQXITXAEMLTNVIS

SEQ ID NO: 256318 - protein, 25 aa, Artificial Sequence
  Description of Artificial Sequence: Synthetic peptide
  Seed: ARFLLLKYQVKQPITKAEMLTNVIS (MAGC1_HUMAN)
  Core: KQPITKAEM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVXQPXTXAEXLTNVIS

SEQ ID NO: 256319 - protein, 25 aa, Artificial Sequence
  Description of Artificial Sequence: Synthetic peptide
  Seed: ARFLLLKYQVKQPITKAEMLTNVIS (MAGC1_HUMAN)
  Core: ITKAEMLTN
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ARFLLLKYQVKQPXTKXEXLTXVIS

SEQ ID NO: 256320 - protein, 13 aa, Artificial Sequence
  Description of Artificial Sequence: Synthetic peptide
  Seed: ASEEVIWDVLSGI (MAGC1_HUMAN)
  Core: EVIWDVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASEXVIXDXLSXI

SEQ ID NO: 256321 - protein, 14 aa, Artificial Sequence
  Description of Artificial Sequence: Synthetic peptide
  Seed: ASEEVIWDVLSGIG (MAGC1_HUMAN)
  Core: EVIWDVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASEXVIXDXLSXIG

SEQ ID NO: 256322 - protein, 15 aa, Artificial Sequence
  Description of Artificial Sequence: Synthetic peptide
  Seed: ASEEVIWDVLSGIGV (MAGC1_HUMAN)
  Core: EVIWDVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASEXVIXDXLSXIGV

SEQ ID NO: 256323 - protein, 15 aa, Artificial Sequence
  Description of Artificial Sequence: Synthetic peptide
  Seed: ASEEVIWDVLSGIGV (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGV

SEQ ID NO: 256324 - protein, 15 aa, Artificial Sequence
  Description of Artificial Sequence: Synthetic peptide
  Seed: ASEEVIWDVLSGIGV (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGX

SEQ ID NO: 256325 - protein, 16 aa, Artificial Sequence
  Description of Artificial Sequence: Synthetic peptide
  Seed: ASEEVIWDVLSGIGVR (MAGC1_HUMAN)
  Core: EVIWDVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASEXVIXDXLSXIGVR

SEQ ID NO: 256326 - protein, 16 aa, Artificial Sequence
  Description of Artificial Sequence: Synthetic peptide
  Seed: ASEEVIWDVLSGIGVR (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVR

SEQ ID NO: 256327 - protein, 16 aa, Artificial Sequence
  Description of Artificial Sequence: Synthetic peptide
  Seed: ASEEVIWDVLSGIGVR (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXR

SEQ ID NO: 256328 - protein, 17 aa, Artificial Sequence
  Description of Artificial Sequence: Synthetic peptide
  Seed: ASEEVIWDVLSGIGVRA (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRA

SEQ ID NO: 256329 - protein, 17 aa, Artificial Sequence
  Description of Artificial Sequence: Synthetic peptide
  Seed: ASEEVIWDVLSGIGVRA (MAGC1_HUMAN)
  Core: IWDVLSGIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVXWDXLXGIXVRA

SEQ ID NO: 256330 - protein, 17 aa, Artificial Sequence
  Description of Artificial Sequence: Synthetic peptide
  Seed: ASEEVIWDVLSGIGVRA (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRA

SEQ ID NO: 256331 - protein, 17 aa, Artificial Sequence
  Description of Artificial Sequence: Synthetic peptide
  Seed: ASEEVIWDVLSGIGVRA (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRX

SEQ ID NO: 256332 - protein, 18 aa, Artificial Sequence
  Description of Artificial Sequence: Synthetic peptide
  Seed: ASEEVIWDVLSGIGVRAG (MAGC1_HUMAN)
  Core: IWDVLSGIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVXWDXLXGIXVRAG

SEQ ID NO: 256333 - protein, 18 aa, Artificial Sequence
  Description of Artificial Sequence: Synthetic peptide
  Seed: ASEEVIWDVLSGIGVRAG (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAG

SEQ ID NO: 256334 - protein, 18 aa, Artificial Sequence
  Description of Artificial Sequence: Synthetic peptide
  Seed: ASEEVIWDVLSGIGVRAG (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXG

SEQ ID NO: 256335 - protein, 18 aa, Artificial Sequence
  Description of Artificial Sequence: Synthetic peptide
  Seed: ASEEVIWDVLSGIGVRAG (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAX

SEQ ID NO: 256336 - protein, 19 aa, Artificial Sequence
  Description of Artificial Sequence: Synthetic peptide
  Seed: ASEEVIWDVLSGIGVRAGR (MAGC1_HUMAN)
  Core: EVIWDVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASEXVIXDXLSXIGVRAGR

SEQ ID NO: 256337 - protein, 19 aa, Artificial Sequence
  Description of Artificial Sequence: Synthetic peptide
  Seed: ASEEVIWDVLSGIGVRAGR (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGR

SEQ ID NO: 256338 - protein, 19 aa, Artificial Sequence
  Description of Artificial Sequence: Synthetic peptide
  Seed: ASEEVIWDVLSGIGVRAGR (MAGC1_HUMAN)
  Core: IWDVLSGIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVXWDXLXGIXVRAGR

SEQ ID NO: 256339 - protein, 19 aa, Artificial Sequence
  Description of Artificial Sequence: Synthetic peptide
  Seed: ASEEVIWDVLSGIGVRAGR (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGR

SEQ ID NO: 256340 - protein, 19 aa, Artificial Sequence
  Description of Artificial Sequence: Synthetic peptide
  Seed: ASEEVIWDVLSGIGVRAGR (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGR

SEQ ID NO: 256341 - protein, 19 aa, Artificial Sequence
  Description of Artificial Sequence: Synthetic peptide
  Seed: ASEEVIWDVLSGIGVRAGR (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXR

SEQ ID NO: 256342 - protein, 20 aa, Artificial Sequence
  Description of Artificial Sequence: Synthetic peptide
  Seed: ASEEVIWDVLSGIGVRAGRE (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGRE

SEQ ID NO: 256343 - protein, 20 aa, Artificial Sequence
  Description of Artificial Sequence: Synthetic peptide
  Seed: ASEEVIWDVLSGIGVRAGRE (MAGC1_HUMAN)
  Core: IWDVLSGIG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVXWDXLXGIXVRAGRE

SEQ ID NO: 256344 - protein, 20 aa, Artificial Sequence
  Description of Artificial Sequence: Synthetic peptide
  Seed: ASEEVIWDVLSGIGVRAGRE (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGRE

SEQ ID NO: 256345 - protein, 20 aa, Artificial Sequence
  Description of Artificial Sequence: Synthetic peptide
  Seed: ASEEVIWDVLSGIGVRAGRE (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGRE

SEQ ID NO: 256346 - protein, 20 aa, Artificial Sequence
  Description of Artificial Sequence: Synthetic peptide
  Seed: ASEEVIWDVLSGIGVRAGRE (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXRE

SEQ ID NO: 256347 - protein, 21 aa, Artificial Sequence
  Description of Artificial Sequence: Synthetic peptide
  Seed: ASEEVIWDVLSGIGVRAGREH (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGREH

SEQ ID NO: 256348 - protein, 21 aa, Artificial Sequence
  Description of Artificial Sequence: Synthetic peptide
  Seed: ASEEVIWDVLSGIGVRAGREH (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGREH

SEQ ID NO: 256349 - protein, 21 aa, Artificial Sequence
  Description of Artificial Sequence: Synthetic peptide
  Seed: ASEEVIWDVLSGIGVRAGREH (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGREH

SEQ ID NO: 256350 - protein, 21 aa, Artificial Sequence
  Description of Artificial Sequence: Synthetic peptide
  Seed: ASEEVIWDVLSGIGVRAGREH (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXREH

SEQ ID NO: 256351 - protein, 22 aa, Artificial Sequence
  Description of Artificial Sequence: Synthetic peptide
  Seed: ASEEVIWDVLSGIGVRAGREHF (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGREHF

SEQ ID NO: 256352 - protein, 22 aa, Artificial Sequence
  Description of Artificial Sequence: Synthetic peptide
  Seed: ASEEVIWDVLSGIGVRAGREHF (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGREHF

SEQ ID NO: 256353 - protein, 22 aa, Artificial Sequence
  Description of Artificial Sequence: Synthetic peptide
  Seed: ASEEVIWDVLSGIGVRAGREHF (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGREHF

SEQ ID NO: 256354 - protein, 22 aa, Artificial Sequence
  Description of Artificial Sequence: Synthetic peptide
  Seed: ASEEVIWDVLSGIGVRAGREHF (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXREHF

SEQ ID NO: 256355 - protein, 23 aa, Artificial Sequence
  Description of Artificial Sequence: Synthetic peptide
  Seed: ASEEVIWDVLSGIGVRAGREHFA (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGREHFA

SEQ ID NO: 256356 - protein, 23 aa, Artificial Sequence
  Description of Artificial Sequence: Synthetic peptide
  Seed: ASEEVIWDVLSGIGVRAGREHFA (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGREHFA

SEQ ID NO: 256357 - protein, 23 aa, Artificial Sequence
  Description of Artificial Sequence: Synthetic peptide
  Seed: ASEEVIWDVLSGIGVRAGREHFA (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGREHFA

SEQ ID NO: 256358 - protein, 23 aa, Artificial Sequence
  Description of Artificial Sequence: Synthetic peptide
  Seed: ASEEVIWDVLSGIGVRAGREHFA (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXREHFA

SEQ ID NO: 256359 - protein, 24 aa, Artificial Sequence
  Description of Artificial Sequence: Synthetic peptide
  Seed: ASEEVIWDVLSGIGVRAGREHFAF (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGREHFAF

SEQ ID NO: 256360 - protein, 24 aa, Artificial Sequence
  Description of Artificial Sequence: Synthetic peptide
  Seed: ASEEVIWDVLSGIGVRAGREHFAF (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGREHFAF

SEQ ID NO: 256361 - protein, 24 aa, Artificial Sequence
  Description of Artificial Sequence: Synthetic peptide
  Seed: ASEEVIWDVLSGIGVRAGREHFAF (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGREHFAF

SEQ ID NO: 256362 - protein, 24 aa, Artificial Sequence
  Description of Artificial Sequence: Synthetic peptide
  Seed: ASEEVIWDVLSGIGVRAGREHFAF (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXREHFAF

SEQ ID NO: 256363 - protein, 25 aa, Artificial Sequence
  Description of Artificial Sequence: Synthetic peptide
  Seed: ASEEVIWDVLSGIGVRAGREHFAFG (MAGC1_HUMAN)
  Core: VIWDVLSGI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASEEXIWXVXSGXGVRAGREHFAFG

SEQ ID NO: 256364 - protein, 25 aa, Artificial Sequence
  Description of Artificial Sequence: Synthetic peptide
  Seed: ASEEVIWDVLSGIGVRAGREHFAFG (MAGC1_HUMAN)
  Core: WDVLSGIGV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIXDVXSXIGXRAGREHFAFG

SEQ ID NO: 256365 - protein, 25 aa, Artificial Sequence
  Description of Artificial Sequence: Synthetic peptide
  Seed: ASEEVIWDVLSGIGVRAGREHFAFG (MAGC1_HUMAN)
  Core: VLSGIGVRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDXLSXIXVRXGREHFAFG

SEQ ID NO: 256366 - protein, 25 aa, Artificial Sequence
  Description of Artificial Sequence: Synthetic peptide
  Seed: ASEEVIWDVLSGIGVRAGREHFAFG (MAGC1_HUMAN)
  Core: LSGIGVRAG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVXSGXGXRAXREHFAFG

SEQ ID NO: 256367 - protein, 25 aa, Artificial Sequence
  Description of Artificial Sequence: Synthetic peptide
  Seed: ASEEVIWDVLSGIGVRAGREHFAFG (MAGC1_HUMAN)
  Core: VRAGREHFA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
ASEEVIWDVLSGIGXRAXRXHFXFG

SEQ ID NO: 256368 - protein, 13 aa, Artificial Sequence
  Description of Artificial Sequence: Synthetic peptide
  Seed: ASSFFSSALLSIF (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXF

SEQ ID NO: 256369 - protein, 14 aa, Artificial Sequence
  Description of Artificial Sequence: Synthetic peptide
  Seed: ASSFFSSALLSIFQ (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQ

SEQ ID NO: 256370 - protein, 14 aa, Artificial Sequence
  Description of Artificial Sequence: Synthetic peptide
  Seed: ASSFFSSALLSIFQ (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQ

SEQ ID NO: 256371 - protein, 15 aa, Artificial Sequence
  Description of Artificial Sequence: Synthetic peptide
  Seed: ASSFFSSALLSIFQS (MAGC1_HUMAN)
  Core: SSFFSSALL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
AXSFXSXALXSIFQS

SEQ ID NO: 256372 - protein, 15 aa, Artificial Sequence
  Description of Artificial Sequence: Synthetic peptide
  Seed: ASSFFSSALLSIFQS (MAGC1_HUMAN)
  Core: SFFSSALLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXFFXSXLLXIFQS

SEQ ID NO: 256373 - protein, 15 aa, Artificial Sequence
  Description of Artificial Sequence: Synthetic peptide
  Seed: ASSFFSSALLSIFQS (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQS

SEQ ID NO: 256374 - protein, 15 aa, Artificial Sequence
  Description of Artificial Sequence: Synthetic peptide
  Seed: ASSFFSSALLSIFQS (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQS

SEQ ID NO: 256375 - protein, 16 aa, Artificial Sequence
  Description of Artificial Sequence: Synthetic peptide
  Seed: ASSFFSSALLSIFQSS (MAGC1_HUMAN)
  Core: SFFSSALLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXFFXSXLLXIFQSS

SEQ ID NO: 256376 - protein, 16 aa, Artificial Sequence
  Description of Artificial Sequence: Synthetic peptide
  Seed: ASSFFSSALLSIFQSS (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSS

SEQ ID NO: 256377 - protein, 16 aa, Artificial Sequence
  Description of Artificial Sequence: Synthetic peptide
  Seed: ASSFFSSALLSIFQSS (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQSS

SEQ ID NO: 256378 - protein, 17 aa, Artificial Sequence
  Description of Artificial Sequence: Synthetic peptide
  Seed: ASSFFSSALLSIFQSSP (MAGC1_HUMAN)
  Core: SFFSSALLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXFFXSXLLXIFQSSP

SEQ ID NO: 256379 - protein, 17 aa, Artificial Sequence
  Description of Artificial Sequence: Synthetic peptide
  Seed: ASSFFSSALLSIFQSSP (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSP

SEQ ID NO: 256380 - protein, 17 aa, Artificial Sequence
  Description of Artificial Sequence: Synthetic peptide
  Seed: ASSFFSSALLSIFQSSP (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQSSP

SEQ ID NO: 256381 - protein, 17 aa, Artificial Sequence
  Description of Artificial Sequence: Synthetic peptide
  Seed: ASSFFSSALLSIFQSSP (MAGC1_HUMAN)
  Core: SSALLSIFQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFXSAXLXIFXSSP

SEQ ID NO: 256382 - protein, 17 aa, Artificial Sequence
  Description of Artificial Sequence: Synthetic peptide
  Seed: ASSFFSSALLSIFQSSP (MAGC1_HUMAN)
  Core: SALLSIFQS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSXALXSXFQXSP

SEQ ID NO: 256383 - protein, 18 aa, Artificial Sequence
  Description of Artificial Sequence: Synthetic peptide
  Seed: ASSFFSSALLSIFQSSPE (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPE

SEQ ID NO: 256384 - protein, 18 aa, Artificial Sequence
  Description of Artificial Sequence: Synthetic peptide
  Seed: ASSFFSSALLSIFQSSPE (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQSSPE

SEQ ID NO: 256385 - protein, 18 aa, Artificial Sequence
  Description of Artificial Sequence: Synthetic peptide
  Seed: ASSFFSSALLSIFQSSPE (MAGC1_HUMAN)
  Core: SALLSIFQS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSXALXSXFQXSPE

SEQ ID NO: 256386 - protein, 18 aa, Artificial Sequence
  Description of Artificial Sequence: Synthetic peptide
  Seed: ASSFFSSALLSIFQSSPE (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPX

SEQ ID NO: 256387 - protein, 19 aa, Artificial Sequence
  Description of Artificial Sequence: Synthetic peptide
  Seed: ASSFFSSALLSIFQSSPES (MAGC1_HUMAN)
  Core: SFFSSALLS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
ASXFFXSXLLXIFQSSPES

SEQ ID NO: 256388 - protein, 19 aa, Artificial Sequence
  Description of Artificial Sequence: Synthetic peptide
  Seed: ASSFFSSALLSIFQSSPES (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPES

SEQ ID NO: 256389 - protein, 19 aa, Artificial Sequence
  Description of Artificial Sequence: Synthetic peptide
  Seed: ASSFFSSALLSIFQSSPES (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQSSPES

SEQ ID NO: 256390 - protein, 19 aa, Artificial Sequence
  Description of Artificial Sequence: Synthetic peptide
  Seed: ASSFFSSALLSIFQSSPES (MAGC1_HUMAN)
  Core: SALLSIFQS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSXALXSXFQXSPES

SEQ ID NO: 256391 - protein, 19 aa, Artificial Sequence
  Description of Artificial Sequence: Synthetic peptide
  Seed: ASSFFSSALLSIFQSSPES (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPES

SEQ ID NO: 256392 - protein, 19 aa, Artificial Sequence
  Description of Artificial Sequence: Synthetic peptide
  Seed: ASSFFSSALLSIFQSSPES (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXS

SEQ ID NO: 256393 - protein, 20 aa, Artificial Sequence
  Description of Artificial Sequence: Synthetic peptide
  Seed: ASSFFSSALLSIFQSSPEST (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPEST

SEQ ID NO: 256394 - protein, 20 aa, Artificial Sequence
  Description of Artificial Sequence: Synthetic peptide
  Seed: ASSFFSSALLSIFQSSPEST (MAGC1_HUMAN)
  Core: FSSALLSIF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSFXSSXLXSIXQSSPEST

SEQ ID NO: 256395 - protein, 20 aa, Artificial Sequence
  Description of Artificial Sequence: Synthetic peptide
  Seed: ASSFFSSALLSIFQSSPEST (MAGC1_HUMAN)
  Core: SALLSIFQS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSXALXSXFQXSPEST

SEQ ID NO: 256396 - protein, 20 aa, Artificial Sequence
  Description of Artificial Sequence: Synthetic peptide
  Seed: ASSFFSSALLSIFQSSPEST (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPEST

SEQ ID NO: 256397 - protein, 20 aa, Artificial Sequence
  Description of Artificial Sequence: Synthetic peptide
  Seed: ASSFFSSALLSIFQSSPEST (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXST

SEQ ID NO: 256398 - protein, 20 aa, Artificial Sequence
  Description of Artificial Sequence: Synthetic peptide
  Seed: ASSFFSSALLSIFQSSPEST (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESX

SEQ ID NO: 256399 - protein, 21 aa, Artificial Sequence
  Description of Artificial Sequence: Synthetic peptide
  Seed: ASSFFSSALLSIFQSSPESTQ (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPESTQ

SEQ ID NO: 256400 - protein, 21 aa, Artificial Sequence
  Description of Artificial Sequence: Synthetic peptide
  Seed: ASSFFSSALLSIFQSSPESTQ (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPESTQ

SEQ ID NO: 256401 - protein, 21 aa, Artificial Sequence
  Description of Artificial Sequence: Synthetic peptide
  Seed: ASSFFSSALLSIFQSSPESTQ (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXSTQ

SEQ ID NO: 256402 - protein, 21 aa, Artificial Sequence
  Description of Artificial Sequence: Synthetic peptide
  Seed: ASSFFSSALLSIFQSSPESTQ (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESXQ

SEQ ID NO: 256403 - protein, 22 aa, Artificial Sequence
  Description of Artificial Sequence: Synthetic peptide
  Seed: ASSFFSSALLSIFQSSPESTQS (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPESTQS

SEQ ID NO: 256404 - protein, 22 aa, Artificial Sequence
  Description of Artificial Sequence: Synthetic peptide
  Seed: ASSFFSSALLSIFQSSPESTQS (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPESTQS

SEQ ID NO: 256405 - protein, 22 aa, Artificial Sequence
  Description of Artificial Sequence: Synthetic peptide
  Seed: ASSFFSSALLSIFQSSPESTQS (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXSTQS

SEQ ID NO: 256406 - protein, 22 aa, Artificial Sequence
  Description of Artificial Sequence: Synthetic peptide
  Seed: ASSFFSSALLSIFQSSPESTQS (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESXQS

SEQ ID NO: 256407 - protein, 23 aa, Artificial Sequence
  Description of Artificial Sequence: Synthetic peptide
  Seed: ASSFFSSALLSIFQSSPESTQSP (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPESTQSP

SEQ ID NO: 256408 - protein, 23 aa, Artificial Sequence
  Description of Artificial Sequence: Synthetic peptide
  Seed: ASSFFSSALLSIFQSSPESTQSP (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPESTQSP

SEQ ID NO: 256409 - protein, 23 aa, Artificial Sequence
  Description of Artificial Sequence: Synthetic peptide
  Seed: ASSFFSSALLSIFQSSPESTQSP (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXSTQSP

SEQ ID NO: 256410 - protein, 23 aa, Artificial Sequence
  Description of Artificial Sequence: Synthetic peptide
  Seed: ASSFFSSALLSIFQSSPESTQSP (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESXQSP

SEQ ID NO: 256411 - protein, 24 aa, Artificial Sequence
  Description of Artificial Sequence: Synthetic peptide
  Seed: ASSFFSSALLSIFQSSPESTQSPF (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPESTQSPF

SEQ ID NO: 256412 - protein, 24 aa, Artificial Sequence
  Description of Artificial Sequence: Synthetic peptide
  Seed: ASSFFSSALLSIFQSSPESTQSPF (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPESTQSPF

SEQ ID NO: 256413 - protein, 24 aa, Artificial Sequence
  Description of Artificial Sequence: Synthetic peptide
  Seed: ASSFFSSALLSIFQSSPESTQSPF (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXSTQSPF

SEQ ID NO: 256414 - protein, 24 aa, Artificial Sequence
  Description of Artificial Sequence: Synthetic peptide
  Seed: ASSFFSSALLSIFQSSPESTQSPF (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESXQSPF

SEQ ID NO: 256415 - protein, 24 aa, Artificial Sequence
  Description of Artificial Sequence: Synthetic peptide
  Seed: ASSFFSSALLSIFQSSPESTQSPF (MAGC1_HUMAN)
  Core: FQSSPESTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSIXQSXPXSTXSPF

SEQ ID NO: 256416 - protein, 25 aa, Artificial Sequence
  Description of Artificial Sequence: Synthetic peptide
  Seed: ASSFFSSALLSIFQSSPESTQSPFE (MAGC1_HUMAN)
  Core: FFSSALLSI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXFSXAXLSXFQSSPESTQSPFE

SEQ ID NO: 256417 - protein, 25 aa, Artificial Sequence
  Description of Artificial Sequence: Synthetic peptide
  Seed: ASSFFSSALLSIFQSSPESTQSPFE (MAGC1_HUMAN)
  Core: ALLSIFQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSXLLXIXQSXPESTQSPFE

SEQ ID NO: 256418 - protein, 25 aa, Artificial Sequence
  Description of Artificial Sequence: Synthetic peptide
  Seed: ASSFFSSALLSIFQSSPESTQSPFE (MAGC1_HUMAN)
  Core: LSIFQSSPE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALXSIXQXSPXSTQSPFE

SEQ ID NO: 256419 - protein, 25 aa, Artificial Sequence
  Description of Artificial Sequence: Synthetic peptide
  Seed: ASSFFSSALLSIFQSSPESTQSPFE (MAGC1_HUMAN)
  Core: IFQSSPEST
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSXFQXSXESXQSPFE

SEQ ID NO: 256420 - protein, 25 aa, Artificial Sequence
  Description of Artificial Sequence: Synthetic peptide
  Seed: ASSFFSSALLSIFQSSPESTQSPFE (MAGC1_HUMAN)
  Core: FQSSPESTQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
ASSFFSSALLSIXQSXPXSTXSPFE

SEQ ID NO: 256421 - protein, 13 aa, Artificial Sequence
  Description of Artificial Sequence: Synthetic peptide
  Seed: ASSSTLVSIFQSS (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXS

SEQ ID NO: 256422 - protein, 13 aa, Artificial Sequence
  Description of Artificial Sequence: Synthetic peptide
  Seed: ASSSTLVSIFQSS (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSX

SEQ ID NO: 256423 - protein, 14 aa, Artificial Sequence
  Description of Artificial Sequence: Synthetic peptide
  Seed: ASSSTLVSIFQSSP (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSP

SEQ ID NO: 256424 - protein, 14 aa, Artificial Sequence
  Description of Artificial Sequence: Synthetic peptide
  Seed: ASSSTLVSIFQSSP (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXP

SEQ ID NO: 256425 - protein, 15 aa, Artificial Sequence
  Description of Artificial Sequence: Synthetic peptide
  Seed: ASSSTLVSIFQSSPE (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPE

SEQ ID NO: 256426 - protein, 15 aa, Artificial Sequence
  Description of Artificial Sequence: Synthetic peptide
  Seed: ASSSTLVSIFQSSPE (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPE

SEQ ID NO: 256427 - protein, 15 aa, Artificial Sequence
  Description of Artificial Sequence: Synthetic peptide
  Seed: ASSSTLVSIFQSSPE (MAGC1_HUMAN)
  Core: LVSIFQSSP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTXVSXFXSSXE

SEQ ID NO: 256428 - protein, 15 aa, Artificial Sequence
  Description of Artificial Sequence: Synthetic peptide
  Seed: ASSSTLVSIFQSSPE (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPX

SEQ ID NO: 256429 - protein, 16 aa, Artificial Sequence
  Description of Artificial Sequence: Synthetic peptide
  Seed: ASSSTLVSIFQSSPES (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPES

SEQ ID NO: 256430 - protein, 16 aa, Artificial Sequence
  Description of Artificial Sequence: Synthetic peptide
  Seed: ASSSTLVSIFQSSPES (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPES

SEQ ID NO: 256431 - protein, 16 aa, Artificial Sequence
  Description of Artificial Sequence: Synthetic peptide
  Seed: ASSSTLVSIFQSSPES (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXS

SEQ ID NO: 256432 - protein, 17 aa, Artificial Sequence
  Description of Artificial Sequence: Synthetic peptide
  Seed: ASSSTLVSIFQSSPEST (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPEST

SEQ ID NO: 256433 - protein, 17 aa, Artificial Sequence
  Description of Artificial Sequence: Synthetic peptide
  Seed: ASSSTLVSIFQSSPEST (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPEST

SEQ ID NO: 256434 - protein, 17 aa, Artificial Sequence
  Description of Artificial Sequence: Synthetic peptide
  Seed: ASSSTLVSIFQSSPEST (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXST

SEQ ID NO: 256435 - protein, 17 aa, Artificial Sequence
  Description of Artificial Sequence: Synthetic peptide
  Seed: ASSSTLVSIFQSSPEST (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESX

SEQ ID NO: 256436 - protein, 18 aa, Artificial Sequence
  Description of Artificial Sequence: Synthetic peptide
  Seed: ASSSTLVSIFQSSPESTQ (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQ

SEQ ID NO: 256437 - protein, 18 aa, Artificial Sequence
  Description of Artificial Sequence: Synthetic peptide
  Seed: ASSSTLVSIFQSSPESTQ (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQ

SEQ ID NO: 256438 - protein, 18 aa, Artificial Sequence
  Description of Artificial Sequence: Synthetic peptide
  Seed: ASSSTLVSIFQSSPESTQ (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQ

SEQ ID NO: 256439 - protein, 18 aa, Artificial Sequence
  Description of Artificial Sequence: Synthetic peptide
  Seed: ASSSTLVSIFQSSPESTQ (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQ

SEQ ID NO: 256440 - protein, 19 aa, Artificial Sequence
  Description of Artificial Sequence: Synthetic peptide
  Seed: ASSSTLVSIFQSSPESTQS (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQS

SEQ ID NO: 256441 - protein, 19 aa, Artificial Sequence
  Description of Artificial Sequence: Synthetic peptide
  Seed: ASSSTLVSIFQSSPESTQS (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQS

SEQ ID NO: 256442 - protein, 19 aa, Artificial Sequence
  Description of Artificial Sequence: Synthetic peptide
  Seed: ASSSTLVSIFQSSPESTQS (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQS

SEQ ID NO: 256443 - protein, 19 aa, Artificial Sequence
  Description of Artificial Sequence: Synthetic peptide
  Seed: ASSSTLVSIFQSSPESTQS (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQS

SEQ ID NO: 256444 - protein, 20 aa, Artificial Sequence
  Description of Artificial Sequence: Synthetic peptide
  Seed: ASSSTLVSIFQSSPESTQSP (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSP

SEQ ID NO: 256445 - protein, 20 aa, Artificial Sequence
  Description of Artificial Sequence: Synthetic peptide
  Seed: ASSSTLVSIFQSSPESTQSP (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSP

SEQ ID NO: 256446 - protein, 20 aa, Artificial Sequence
  Description of Artificial Sequence: Synthetic peptide
  Seed: ASSSTLVSIFQSSPESTQSP (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSP

SEQ ID NO: 256447 - protein, 20 aa, Artificial Sequence
  Description of Artificial Sequence: Synthetic peptide
  Seed: ASSSTLVSIFQSSPESTQSP (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSP

SEQ ID NO: 256448 - protein, 21 aa, Artificial Sequence
  Description of Artificial Sequence: Synthetic peptide
  Seed: ASSSTLVSIFQSSPESTQSPF (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSPF

SEQ ID NO: 256449 - protein, 21 aa, Artificial Sequence
  Description of Artificial Sequence: Synthetic peptide
  Seed: ASSSTLVSIFQSSPESTQSPF (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSPF

SEQ ID NO: 256450 - protein, 21 aa, Artificial Sequence
  Description of Artificial Sequence: Synthetic peptide
  Seed: ASSSTLVSIFQSSPESTQSPF (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSPF

SEQ ID NO: 256451 - protein, 21 aa, Artificial Sequence
  Description of Artificial Sequence: Synthetic peptide
  Seed: ASSSTLVSIFQSSPESTQSPF (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSPF

SEQ ID NO: 256452 - protein, 21 aa, Artificial Sequence
  Description of Artificial Sequence: Synthetic peptide
  Seed: ASSSTLVSIFQSSPESTQSPF (MAGC1_HUMAN)
  Core: FQSSPESTQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIXQSXPXSTXSPF

SEQ ID NO: 256453 - protein, 22 aa, Artificial Sequence
  Description of Artificial Sequence: Synthetic peptide
  Seed: ASSSTLVSIFQSSPESTQSPFE (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSPFE

SEQ ID NO: 256454 - protein, 22 aa, Artificial Sequence
  Description of Artificial Sequence: Synthetic peptide
  Seed: ASSSTLVSIFQSSPESTQSPFE (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSPFE

SEQ ID NO: 256455 - protein, 22 aa, Artificial Sequence
  Description of Artificial Sequence: Synthetic peptide
  Seed: ASSSTLVSIFQSSPESTQSPFE (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSPFE

SEQ ID NO: 256456 - protein, 22 aa, Artificial Sequence
  Description of Artificial Sequence: Synthetic peptide
  Seed: ASSSTLVSIFQSSPESTQSPFE (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSPFE

SEQ ID NO: 256457 - protein, 22 aa, Artificial Sequence
  Description of Artificial Sequence: Synthetic peptide
  Seed: ASSSTLVSIFQSSPESTQSPFE (MAGC1_HUMAN)
  Core: FQSSPESTQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIXQSXPXSTXSPFE

SEQ ID NO: 256458 - protein, 23 aa, Artificial Sequence
  Description of Artificial Sequence: Synthetic peptide
  Seed: ASSSTLVSIFQSSPESTQSPFEG (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSPFEG

SEQ ID NO: 256459 - protein, 23 aa, Artificial Sequence
  Description of Artificial Sequence: Synthetic peptide
  Seed: ASSSTLVSIFQSSPESTQSPFEG (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSPFEG

SEQ ID NO: 256460 - protein, 23 aa, Artificial Sequence
  Description of Artificial Sequence: Synthetic peptide
  Seed: ASSSTLVSIFQSSPESTQSPFEG (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSPFEG

SEQ ID NO: 256461 - protein, 23 aa, Artificial Sequence
  Description of Artificial Sequence: Synthetic peptide
  Seed: ASSSTLVSIFQSSPESTQSPFEG (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSPFEG

SEQ ID NO: 256462 - protein, 23 aa, Artificial Sequence
  Description of Artificial Sequence: Synthetic peptide
  Seed: ASSSTLVSIFQSSPESTQSPFEG (MAGC1_HUMAN)
  Core: FQSSPESTQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIXQSXPXSTXSPFEG

SEQ ID NO: 256463 - protein, 24 aa, Artificial Sequence
  Description of Artificial Sequence: Synthetic peptide
  Seed: ASSSTLVSIFQSSPESTQSPFEGF (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSPFEGF

SEQ ID NO: 256464 - protein, 24 aa, Artificial Sequence
  Description of Artificial Sequence: Synthetic peptide
  Seed: ASSSTLVSIFQSSPESTQSPFEGF (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSPFEGF

SEQ ID NO: 256465 - protein, 24 aa, Artificial Sequence
  Description of Artificial Sequence: Synthetic peptide
  Seed: ASSSTLVSIFQSSPESTQSPFEGF (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSPFEGF

SEQ ID NO: 256466 - protein, 24 aa, Artificial Sequence
  Description of Artificial Sequence: Synthetic peptide
  Seed: ASSSTLVSIFQSSPESTQSPFEGF (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSPFEGF

SEQ ID NO: 256467 - protein, 24 aa, Artificial Sequence
  Description of Artificial Sequence: Synthetic peptide
  Seed: ASSSTLVSIFQSSPESTQSPFEGF (MAGC1_HUMAN)
  Core: FQSSPESTQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIXQSXPXSTXSPFEGF

SEQ ID NO: 256468 - protein, 24 aa, Artificial Sequence
  Description of Artificial Sequence: Synthetic peptide
  Seed: ASSSTLVSIFQSSPESTQSPFEGF (MAGC1_HUMAN)
  Core: PESTQSPFE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIFQSSXESXQXPFXGF

SEQ ID NO: 256469 - protein, 25 aa, Artificial Sequence
  Description of Artificial Sequence: Synthetic peptide
  Seed: ASSSTLVSIFQSSPESTQSPFEGFP (MAGC1_HUMAN)
  Core: STLVSIFQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXTLXSXFQXSPESTQSPFEGFP

SEQ ID NO: 256470 - protein, 25 aa, Artificial Sequence
  Description of Artificial Sequence: Synthetic peptide
  Seed: ASSSTLVSIFQSSPESTQSPFEGFP (MAGC1_HUMAN)
  Core: TLVSIFQSS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ASSSXLVXIXQSXPESTQSPFEGFP

SEQ ID NO: 256471 - protein, 25 aa, Artificial Sequence
  Description of Artificial Sequence: Synthetic peptide
  Seed: ASSSTLVSIFQSSPESTQSPFEGFP (MAGC1_HUMAN)
  Core: VSIFQSSPE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLXSIXQXSPXSTQSPFEGFP

SEQ ID NO: 256472 - protein, 25 aa, Artificial Sequence
  Description of Artificial Sequence: Synthetic peptide
  Seed: ASSSTLVSIFQSSPESTQSPFEGFP (MAGC1_HUMAN)
  Core: IFQSSPEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSXFQXSXESXQSPFEGFP

SEQ ID NO: 256473 - protein, 25 aa, Artificial Sequence
  Description of Artificial Sequence: Synthetic peptide
  Seed: ASSSTLVSIFQSSPESTQSPFEGFP (MAGC1_HUMAN)
  Core: FQSSPESTQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIXQSXPXSTXSPFEGFP

SEQ ID NO: 256474 - protein, 25 aa, Artificial Sequence
  Description of Artificial Sequence: Synthetic peptide
  Seed: ASSSTLVSIFQSSPESTQSPFEGFP (MAGC1_HUMAN)
  Core: PESTQSPFE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
ASSSTLVSIFQSSXESXQXPFXGFP

SEQ ID NO: 256475 - protein, 13 aa, Artificial Sequence
  Description of Artificial Sequence: Synthetic peptide
  Seed: ASSSVMSPSFSSE (MAGC1_HUMAN)
  Core: SVMSPSFSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
ASSXVMXPXFSXE

SEQ ID NO: 256476 - protein, 13 aa, Artificial Sequence
  Description of Artificial Sequence: Synthetic peptide
  Seed: ATESASSSVMSPS (MAGC1_HUMAN)
  Core: ASSSVMSPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ATESXSSXVXSPX

SEQ ID NO: 256477 - protein, 14 aa, Artificial Sequence
  Description of Artificial Sequence: Synthetic peptide
  Seed: ATESASSSVMSPSF (MAGC1_HUMAN)
  Core: ASSSVMSPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ATESXSSXVXSPXF

SEQ ID NO: 256478 - protein, 15 aa, Artificial Sequence
  Description of Artificial Sequence: Synthetic peptide
  Seed: ATESASSSVMSPSFS (MAGC1_HUMAN)
  Core: ASSSVMSPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ATESXSSXVXSPXFS

SEQ ID NO: 256479 - protein, 16 aa, Artificial Sequence
  Description of Artificial Sequence: Synthetic peptide
  Seed: ATESASSSVMSPSFSS (MAGC1_HUMAN)
  Core: ASSSVMSPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ATESXSSXVXSPXFSS

SEQ ID NO: 256480 - protein, 17 aa, Artificial Sequence
  Description of Artificial Sequence: Synthetic peptide
  Seed: ATESASSSVMSPSFSSE (MAGC1_HUMAN)
  Core: ASSSVMSPS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
ATESXSSXVXSPXFSSE

SEQ ID NO: 256481 - protein, 16 aa, Artificial Sequence
  Description of Artificial Sequence: Synthetic peptide
  Seed: CLSDEQGMSQNRLLIL (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXIL

SEQ ID NO: 256482 - protein, 16 aa, Artificial Sequence
  Description of Artificial Sequence: Synthetic peptide
  Seed: CLSDEQGMSQNRLLIL (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIX

SEQ ID NO: 256483 - protein, 17 aa, Artificial Sequence
  Description of Artificial Sequence: Synthetic peptide
  Seed: CLSDEQGMSQNRLLILI (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILI

SEQ ID NO: 256484 - protein, 17 aa, Artificial Sequence
  Description of Artificial Sequence: Synthetic peptide
  Seed: CLSDEQGMSQNRLLILI (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXI

SEQ ID NO: 256485 - protein, 18 aa, Artificial Sequence
  Description of Artificial Sequence: Synthetic peptide
  Seed: CLSDEQGMSQNRLLILIL (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXIL

SEQ ID NO: 256486 - protein, 19 aa, Artificial Sequence
  Description of Artificial Sequence: Synthetic peptide
  Seed: CLSDEQGMSQNRLLILILS (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILS

SEQ ID NO: 256487 - protein, 19 aa, Artificial Sequence
  Description of Artificial Sequence: Synthetic peptide
  Seed: CLSDEQGMSQNRLLILILS (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILS

SEQ ID NO: 256488 - protein, 20 aa, Artificial Sequence
  Description of Artificial Sequence: Synthetic peptide
  Seed: CLSDEQGMSQNRLLILILSI (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSI

SEQ ID NO: 256489 - protein, 20 aa, Artificial Sequence
  Description of Artificial Sequence: Synthetic peptide
  Seed: CLSDEQGMSQNRLLILILSI (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSI

SEQ ID NO: 256490 - protein, 20 aa, Artificial Sequence
  Description of Artificial Sequence: Synthetic peptide
  Seed: CLSDEQGMSQNRLLILILSI (MAGC1_HUMAN)
  Core: RLLILILSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGMSQNXLLXLXLSX

SEQ ID NO: 256491 - protein, 21 aa, Artificial Sequence
  Description of Artificial Sequence: Synthetic peptide
  Seed: CLSDEQGMSQNRLLILILSII (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSII

SEQ ID NO: 256492 - protein, 21 aa, Artificial Sequence
  Description of Artificial Sequence: Synthetic peptide
  Seed: CLSDEQGMSQNRLLILILSII (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSII

SEQ ID NO: 256493 - protein, 21 aa, Artificial Sequence
  Description of Artificial Sequence: Synthetic peptide
  Seed: CLSDEQGMSQNRLLILILSII (MAGC1_HUMAN)
  Core: RLLILILSI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGMSQNXLLXLXLSXI

SEQ ID NO: 256494 - protein, 22 aa, Artificial Sequence
  Description of Artificial Sequence: Synthetic peptide
  Seed: CLSDEQGMSQNRLLILILSIIF (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSIIF

SEQ ID NO: 256495 - protein, 22 aa, Artificial Sequence
  Description of Artificial Sequence: Synthetic peptide
  Seed: CLSDEQGMSQNRLLILILSIIF (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSIIF

SEQ ID NO: 256496 - protein, 23 aa, Artificial Sequence
  Description of Artificial Sequence: Synthetic peptide
  Seed: CLSDEQGMSQNRLLILILSIIFI (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSIIFI

SEQ ID NO: 256497 - protein, 23 aa, Artificial Sequence
  Description of Artificial Sequence: Synthetic peptide
  Seed: CLSDEQGMSQNRLLILILSIIFI (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSIIFI

SEQ ID NO: 256498 - protein, 24 aa, Artificial Sequence
  Description of Artificial Sequence: Synthetic peptide
  Seed: CLSDEQGMSQNRLLILILSIIFIK (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSIIFIK

SEQ ID NO: 256499 - protein, 24 aa, Artificial Sequence
  Description of Artificial Sequence: Synthetic peptide
  Seed: CLSDEQGMSQNRLLILILSIIFIK (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSIIFIK

SEQ ID NO: 256500 - protein, 25 aa, Artificial Sequence
  Description of Artificial Sequence: Synthetic peptide
  Seed: CLSDEQGMSQNRLLILILSIIFIKG (MAGC1_HUMAN)
  Core: QGMSQNRLL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEXGMXQXRLXILILSIIFIKG

SEQ ID NO: 256501 - protein, 25 aa, Artificial Sequence
  Description of Artificial Sequence: Synthetic peptide
  Seed: CLSDEQGMSQNRLLILILSIIFIKG (MAGC1_HUMAN)
  Core: MSQNRLLIL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
CLSDEQGXSQXRXLIXILSIIFIKG

SEQ ID NO: 256502 - protein, 15 aa, Artificial Sequence
  Description of Artificial Sequence: Synthetic peptide
  Seed: CSSSTPSSLPQSFPE (MAGC1_HUMAN)
  Core: TPSSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXPSXLXQSXPE

SEQ ID NO: 256503 - protein, 14 aa, Artificial Sequence
  Description of Artificial Sequence: Synthetic peptide
  Seed: CSSSTSLSLPQSFP (MAGC1_HUMAN)
  Core: TSLSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXSLXLXQSXP

SEQ ID NO: 256504 - protein, 15 aa, Artificial Sequence
  Description of Artificial Sequence: Synthetic peptide
  Seed: CSSSTSLSLPQSFPE (MAGC1_HUMAN)
  Core: STSLSLPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
CSSXTSXSXPQXFPE

SEQ ID NO: 256505 - protein, 15 aa, Artificial Sequence
  Description of Artificial Sequence: Synthetic peptide
  Seed: CSSSTSLSLPQSFPE (MAGC1_HUMAN)
  Core: TSLSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXSLXLXQSXPE

SEQ ID NO: 256506 - protein, 16 aa, Artificial Sequence
  Description of Artificial Sequence: Synthetic peptide
  Seed: CSSSTSLSLPQSFPES (MAGC1_HUMAN)
  Core: TSLSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXSLXLXQSXPES

SEQ ID NO: 256507 - protein, 17 aa, Artificial Sequence
  Description of Artificial Sequence: Synthetic peptide
  Seed: CSSSTSLSLPQSFPESP (MAGC1_HUMAN)
  Core: TSLSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXSLXLXQSXPESP

SEQ ID NO: 256508 - protein, 20 aa, Artificial Sequence
  Description of Artificial Sequence: Synthetic peptide
  Seed: CSSSTSLSLPQSFPESPQSP (MAGC1_HUMAN)
  Core: TSLSLPQSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
CSSSXSLXLXQSXPESPQSP

SEQ ID NO: 256509 - protein, 14 aa, Artificial Sequence
  Description of Artificial Sequence: Synthetic peptide
  Seed: CTQSTFEGFPQSPL (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPX

SEQ ID NO: 256510 - protein, 15 aa, Artificial Sequence
  Description of Artificial Sequence: Synthetic peptide
  Seed: CTQSTFEGFPQSPLQ (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQ

SEQ ID NO: 256511 - protein, 16 aa, Artificial Sequence
  Description of Artificial Sequence: Synthetic peptide
  Seed: CTQSTFEGFPQSPLQI (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQI

SEQ ID NO: 256512 - protein, 17 aa, Artificial Sequence
  Description of Artificial Sequence: Synthetic peptide
  Seed: CTQSTFEGFPQSPLQIP (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIP

SEQ ID NO: 256513 - protein, 19 aa, Artificial Sequence
  Description of Artificial Sequence: Synthetic peptide
  Seed: CTQSTFEGFPQSPLQIPQS (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQS

SEQ ID NO: 256514 - protein, 20 aa, Artificial Sequence
  Description of Artificial Sequence: Synthetic peptide
  Seed: CTQSTFEGFPQSPLQIPQSP (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSP

SEQ ID NO: 256515 - protein, 21 aa, Artificial Sequence
  Description of Artificial Sequence: Synthetic peptide
  Seed: CTQSTFEGFPQSPLQIPQSPP (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSPP

SEQ ID NO: 256516 - protein, 22 aa, Artificial Sequence
  Description of Artificial Sequence: Synthetic peptide
  Seed: CTQSTFEGFPQSPLQIPQSPPE (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSPPE

SEQ ID NO: 256517 - protein, 23 aa, Artificial Sequence
  Description of Artificial Sequence: Synthetic peptide
  Seed: CTQSTFEGFPQSPLQIPQSPPEG (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSPPEG

SEQ ID NO: 256518 - protein, 24 aa, Artificial Sequence
  Description of Artificial Sequence: Synthetic peptide
  Seed: CTQSTFEGFPQSPLQIPQSPPEGE (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSPPEGE

SEQ ID NO: 256519 - protein, 25 aa, Artificial Sequence
  Description of Artificial Sequence: Synthetic peptide
  Seed: CTQSTFEGFPQSPLQIPQSPPEGEN (MAGC1_HUMAN)
  Core: FEGFPQSPL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
CTQSTXEGXPXSPXQIPQSPPEGEN

SEQ ID NO: 256520 - protein, 24 aa, Artificial Sequence
  Description of Artificial Sequence: Synthetic peptide
  Seed: DALKDVEERAQAIIDTTDDSTATE (MAGC1_HUMAN)
  Core: AQAIIDTTD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DALKDVEERXQAXIXTTXDSTATE

SEQ ID NO: 256521 - protein, 25 aa, Artificial Sequence
  Description of Artificial Sequence: Synthetic peptide
  Seed: DALKDVEERAQAIIDTTDDSTATES (MAGC1_HUMAN)
  Core: AQAIIDTTD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DALKDVEERXQAXIXTTXDSTATES

SEQ ID NO: 256522 - protein, 14 aa, Artificial Sequence
  Description of Artificial Sequence: Synthetic peptide
  Seed: DDSTATESASSSVM (MAGC1_HUMAN)
  Core: TATESASSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXATXSXSSXVM

SEQ ID NO: 256523 - protein, 15 aa, Artificial Sequence
  Description of Artificial Sequence: Synthetic peptide
  Seed: DDSTATESASSSVMS (MAGC1_HUMAN)
  Core: STATESASS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DDXTAXEXASXSVMS

SEQ ID NO: 256524 - protein, 15 aa, Artificial Sequence
  Description of Artificial Sequence: Synthetic peptide
  Seed: DDSTATESASSSVMS (MAGC1_HUMAN)
  Core: TATESASSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXATXSXSSXVMS

SEQ ID NO: 256525 - protein, 16 aa, Artificial Sequence
  Description of Artificial Sequence: Synthetic peptide
  Seed: DDSTATESASSSVMSP (MAGC1_HUMAN)
  Core: STATESASS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DDXTAXEXASXSVMSP

SEQ ID NO: 256526 - protein, 16 aa, Artificial Sequence
  Description of Artificial Sequence: Synthetic peptide
  Seed: DDSTATESASSSVMSP (MAGC1_HUMAN)
  Core: TATESASSS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXATXSXSSXVMSP

SEQ ID NO: 256527 - protein, 16 aa, Artificial Sequence
  Description of Artificial Sequence: Synthetic peptide
  Seed: DDSTATESASSSVMSP (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSP

SEQ ID NO: 256528 - protein, 17 aa, Artificial Sequence
  Description of Artificial Sequence: Synthetic peptide
  Seed: DDSTATESASSSVMSPS (MAGC1_HUMAN)
  Core: STATESASS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DDXTAXEXASXSVMSPS

SEQ ID NO: 256529 - protein, 17 aa, Artificial Sequence
  Description of Artificial Sequence: Synthetic peptide
  Seed: DDSTATESASSSVMSPS (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSPS

SEQ ID NO: 256530 - protein, 17 aa, Artificial Sequence
  Description of Artificial Sequence: Synthetic peptide
  Seed: DDSTATESASSSVMSPS (MAGC1_HUMAN)
  Core: ESASSSVMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATXSAXSXVMXPS

SEQ ID NO: 256531 - protein, 18 aa, Artificial Sequence
  Description of Artificial Sequence: Synthetic peptide
  Seed: DDSTATESASSSVMSPSF (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSPSF

SEQ ID NO: 256532 - protein, 18 aa, Artificial Sequence
  Description of Artificial Sequence: Synthetic peptide
  Seed: DDSTATESASSSVMSPSF (MAGC1_HUMAN)
  Core: ESASSSVMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATXSAXSXVMXPSF

SEQ ID NO: 256533 - protein, 19 aa, Artificial Sequence
  Description of Artificial Sequence: Synthetic peptide
  Seed: DDSTATESASSSVMSPSFS (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSPSFS

SEQ ID NO: 256534 - protein, 19 aa, Artificial Sequence
  Description of Artificial Sequence: Synthetic peptide
  Seed: DDSTATESASSSVMSPSFS (MAGC1_HUMAN)
  Core: ESASSSVMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATXSAXSXVMXPSFS

SEQ ID NO: 256535 - protein, 19 aa, Artificial Sequence
  Description of Artificial Sequence: Synthetic peptide
  Seed: DDSTATESASSSVMSPSFS (MAGC1_HUMAN)
  Core: ASSSVMSPS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATESXSSXVXSPXFS

SEQ ID NO: 256536 - protein, 20 aa, Artificial Sequence
  Description of Artificial Sequence: Synthetic peptide
  Seed: DDSTATESASSSVMSPSFSS (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSPSFSS

SEQ ID NO: 256537 - protein, 20 aa, Artificial Sequence
  Description of Artificial Sequence: Synthetic peptide
  Seed: DDSTATESASSSVMSPSFSS (MAGC1_HUMAN)
  Core: ESASSSVMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATXSAXSXVMXPSFSS

SEQ ID NO: 256538 - protein, 20 aa, Artificial Sequence
  Description of Artificial Sequence: Synthetic peptide
  Seed: DDSTATESASSSVMSPSFSS (MAGC1_HUMAN)
  Core: ASSSVMSPS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATESXSSXVXSPXFSS

SEQ ID NO: 256539 - protein, 21 aa, Artificial Sequence
  Description of Artificial Sequence: Synthetic peptide
  Seed: DDSTATESASSSVMSPSFSSE (MAGC1_HUMAN)
  Core: TESASSSVM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSTAXESXSXSVXSPSFSSE

SEQ ID NO: 256540 - protein, 21 aa, Artificial Sequence
  Description of Artificial Sequence: Synthetic peptide
  Seed: DDSTATESASSSVMSPSFSSE (MAGC1_HUMAN)
  Core: ASSSVMSPS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DDSTATESXSSXVXSPXFSSE

SEQ ID NO: 256541 - protein, 13 aa, Artificial Sequence
  Description of Artificial Sequence: Synthetic peptide
  Seed: DDSYVFVNTLDLT (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXT

SEQ ID NO: 256542 - protein, 14 aa, Artificial Sequence
  Description of Artificial Sequence: Synthetic peptide
  Seed: DDSYVFVNTLDLTS (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTS

SEQ ID NO: 256543 - protein, 15 aa, Artificial Sequence
  Description of Artificial Sequence: Synthetic peptide
  Seed: DDSYVFVNTLDLTSE (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSE

SEQ ID NO: 256544 - protein, 16 aa, Artificial Sequence
  Description of Artificial Sequence: Synthetic peptide
  Seed: DDSYVFVNTLDLTSEG (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEG

SEQ ID NO: 256545 - protein, 16 aa, Artificial Sequence
  Description of Artificial Sequence: Synthetic peptide
  Seed: DDSYVFVNTLDLTSEG (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEG

SEQ ID NO: 256546 - protein, 16 aa, Artificial Sequence
  Description of Artificial Sequence: Synthetic peptide
  Seed: DDSYVFVNTLDLTSEG (MAGC1_HUMAN)
  Core: FVNTLDLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSYVXVNXLXLTXEG

SEQ ID NO: 256547 - protein, 17 aa, Artificial Sequence
  Description of Artificial Sequence: Synthetic peptide
  Seed: DDSYVFVNTLDLTSEGC (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGC

SEQ ID NO: 256548 - protein, 17 aa, Artificial Sequence
  Description of Artificial Sequence: Synthetic peptide
  Seed: DDSYVFVNTLDLTSEGC (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGC

SEQ ID NO: 256549 - protein, 17 aa, Artificial Sequence
  Description of Artificial Sequence: Synthetic peptide
  Seed: DDSYVFVNTLDLTSEGC (MAGC1_HUMAN)
  Core: FVNTLDLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DDSYVXVNXLXLTXEGC

SEQ ID NO: 256550 - protein, 18 aa, Artificial Sequence
  Description of Artificial Sequence: Synthetic peptide
  Seed: DDSYVFVNTLDLTSEGCL (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCL

SEQ ID NO: 256551 - protein, 18 aa, Artificial Sequence
  Description of Artificial Sequence: Synthetic peptide
  Seed: DDSYVFVNTLDLTSEGCL (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCL

SEQ ID NO: 256552 - protein, 19 aa, Artificial Sequence
  Description of Artificial Sequence: Synthetic peptide
  Seed: DDSYVFVNTLDLTSEGCLS (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLS

SEQ ID NO: 256553 - protein, 19 aa, Artificial Sequence
  Description of Artificial Sequence: Synthetic peptide
  Seed: DDSYVFVNTLDLTSEGCLS (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLS

SEQ ID NO: 256554 - protein, 20 aa, Artificial Sequence
  Description of Artificial Sequence: Synthetic peptide
  Seed: DDSYVFVNTLDLTSEGCLSD (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSD

SEQ ID NO: 256555 - protein, 20 aa, Artificial Sequence
  Description of Artificial Sequence: Synthetic peptide
  Seed: DDSYVFVNTLDLTSEGCLSD (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSD

SEQ ID NO: 256556 - protein, 21 aa, Artificial Sequence
  Description of Artificial Sequence: Synthetic peptide
  Seed: DDSYVFVNTLDLTSEGCLSDE (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSDE

SEQ ID NO: 256557 - protein, 21 aa, Artificial Sequence
  Description of Artificial Sequence: Synthetic peptide
  Seed: DDSYVFVNTLDLTSEGCLSDE (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSDE

SEQ ID NO: 256558 - protein, 22 aa, Artificial Sequence
  Description of Artificial Sequence: Synthetic peptide
  Seed: DDSYVFVNTLDLTSEGCLSDEQ (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSDEQ

SEQ ID NO: 256559 - protein, 22 aa, Artificial Sequence
  Description of Artificial Sequence: Synthetic peptide
  Seed: DDSYVFVNTLDLTSEGCLSDEQ (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSDEQ

SEQ ID NO: 256560 - protein, 23 aa, Artificial Sequence
  Description of Artificial Sequence: Synthetic peptide
  Seed: DDSYVFVNTLDLTSEGCLSDEQG (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSDEQG

SEQ ID NO: 256561 - protein, 23 aa, Artificial Sequence
  Description of Artificial Sequence: Synthetic peptide
  Seed: DDSYVFVNTLDLTSEGCLSDEQG (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSDEQG

SEQ ID NO: 256562 - protein, 23 aa, Artificial Sequence
  Description of Artificial Sequence: Synthetic peptide
  Seed: DDSYVFVNTLDLTSEGCLSDEQG (MAGC1_HUMAN)
  Core: LTSEGCLSD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDSYVFVNTLDXTSXGXLSXEQG

SEQ ID NO: 256563 - protein, 24 aa, Artificial Sequence
  Description of Artificial Sequence: Synthetic peptide
  Seed: DDSYVFVNTLDLTSEGCLSDEQGM (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSDEQGM

SEQ ID NO: 256564 - protein, 24 aa, Artificial Sequence
  Description of Artificial Sequence: Synthetic peptide
  Seed: DDSYVFVNTLDLTSEGCLSDEQGM (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSDEQGM

SEQ ID NO: 256565 - protein, 24 aa, Artificial Sequence
  Description of Artificial Sequence: Synthetic peptide
  Seed: DDSYVFVNTLDLTSEGCLSDEQGM (MAGC1_HUMAN)
  Core: LTSEGCLSD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDSYVFVNTLDXTSXGXLSXEQGM

SEQ ID NO: 256566 - protein, 25 aa, Artificial Sequence
  Description of Artificial Sequence: Synthetic peptide
  Seed: DDSYVFVNTLDLTSEGCLSDEQGMS (MAGC1_HUMAN)
  Core: YVFVNTLDL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDSXVFXNXLDXTSEGCLSDEQGMS

SEQ ID NO: 256567 - protein, 25 aa, Artificial Sequence
  Description of Artificial Sequence: Synthetic peptide
  Seed: DDSYVFVNTLDLTSEGCLSDEQGMS (MAGC1_HUMAN)
  Core: VFVNTLDLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DDSYXFVXTXDLXSEGCLSDEQGMS

SEQ ID NO: 256568 - protein, 25 aa, Artificial Sequence
  Description of Artificial Sequence: Synthetic peptide
  Seed: DDSYVFVNTLDLTSEGCLSDEQGMS (MAGC1_HUMAN)
  Core: LTSEGCLSD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DDSYVFVNTLDXTSXGXLSXEQGMS

SEQ ID NO: 256569 - protein, 14 aa, Artificial Sequence
  Description of Artificial Sequence: Synthetic peptide
  Seed: DDTLYPLQSPQSRS (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRS

SEQ ID NO: 256570 - protein, 15 aa, Artificial Sequence
  Description of Artificial Sequence: Synthetic peptide
  Seed: DDTLYPLQSPQSRSE (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSE

SEQ ID NO: 256571 - protein, 16 aa, Artificial Sequence
  Description of Artificial Sequence: Synthetic peptide
  Seed: DDTLYPLQSPQSRSEG (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEG

SEQ ID NO: 256572 - protein, 17 aa, Artificial Sequence
  Description of Artificial Sequence: Synthetic peptide
  Seed: DDTLYPLQSPQSRSEGE (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGE

SEQ ID NO: 256573 - protein, 19 aa, Artificial Sequence
  Description of Artificial Sequence: Synthetic peptide
  Seed: DDTLYPLQSPQSRSEGEDS (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDS

SEQ ID NO: 256574 - protein, 20 aa, Artificial Sequence
  Description of Artificial Sequence: Synthetic peptide
  Seed: DDTLYPLQSPQSRSEGEDSS (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSS

SEQ ID NO: 256575 - protein, 21 aa, Artificial Sequence
  Description of Artificial Sequence: Synthetic peptide
  Seed: DDTLYPLQSPQSRSEGEDSSD (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSSD

SEQ ID NO: 256576 - protein, 22 aa, Artificial Sequence
  Description of Artificial Sequence: Synthetic peptide
  Seed: DDTLYPLQSPQSRSEGEDSSDP (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSSDP

SEQ ID NO: 256577 - protein, 23 aa, Artificial Sequence
  Description of Artificial Sequence: Synthetic peptide
  Seed: DDTLYPLQSPQSRSEGEDSSDPL (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSSDPL

SEQ ID NO: 256578 - protein, 24 aa, Artificial Sequence
  Description of Artificial Sequence: Synthetic peptide
  Seed: DDTLYPLQSPQSRSEGEDSSDPLQ (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSSDPLQ

SEQ ID NO: 256579 - protein, 25 aa, Artificial Sequence
  Description of Artificial Sequence: Synthetic peptide
  Seed: DDTLYPLQSPQSRSEGEDSSDPLQR (MAGC1_HUMAN)
  Core: LYPLQSPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DDTXYPXQXPQXRSEGEDSSDPLQR

SEQ ID NO: 256580 - protein, 13 aa, Artificial Sequence
  Description of Artificial Sequence: Synthetic peptide
  Seed: DEKVDELARFLLL (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLL

SEQ ID NO: 256581 - protein, 13 aa, Artificial Sequence
  Description of Artificial Sequence: Synthetic peptide
  Seed: DEKVDELARFLLL (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXL

SEQ ID NO: 256582 - protein, 13 aa, Artificial Sequence
  Description of Artificial Sequence: Synthetic peptide
  Seed: DEKVDELARFLLL (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLX

SEQ ID NO: 256583 - protein, 14 aa, Artificial Sequence
  Description of Artificial Sequence: Synthetic peptide
  Seed: DEKVDELARFLLLK (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLK

SEQ ID NO: 256584 - protein, 14 aa, Artificial Sequence
  Description of Artificial Sequence: Synthetic peptide
  Seed: DEKVDELARFLLLK (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLK

SEQ ID NO: 256585 - protein, 14 aa, Artificial Sequence
  Description of Artificial Sequence: Synthetic peptide
  Seed: DEKVDELARFLLLK (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXK

SEQ ID NO: 256586 - protein, 15 aa, Artificial Sequence
  Description of Artificial Sequence: Synthetic peptide
  Seed: DEKVDELARFLLLKY (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLKY

SEQ ID NO: 256587 - protein, 15 aa, Artificial Sequence
  Description of Artificial Sequence: Synthetic peptide
  Seed: DEKVDELARFLLLKY (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKY

SEQ ID NO: 256588 - protein, 15 aa, Artificial Sequence
  Description of Artificial Sequence: Synthetic peptide
  Seed: DEKVDELARFLLLKY (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKY

SEQ ID NO: 256589 - protein, 15 aa, Artificial Sequence
  Description of Artificial Sequence: Synthetic peptide
  Seed: DEKVDELARFLLLKY (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKX

SEQ ID NO: 256590 - protein, 16 aa, Artificial Sequence
  Description of Artificial Sequence: Synthetic peptide
  Seed: DEKVDELARFLLLKYQ (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLKYQ

SEQ ID NO: 256591 - protein, 16 aa, Artificial Sequence
  Description of Artificial Sequence: Synthetic peptide
  Seed: DEKVDELARFLLLKYQ (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKYQ

SEQ ID NO: 256592 - protein, 16 aa, Artificial Sequence
  Description of Artificial Sequence: Synthetic peptide
  Seed: DEKVDELARFLLLKYQ (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQ

SEQ ID NO: 256593 - protein, 16 aa, Artificial Sequence
  Description of Artificial Sequence: Synthetic peptide
  Seed: DEKVDELARFLLLKYQ (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQ

SEQ ID NO: 256594 - protein, 17 aa, Artificial Sequence
  Description of Artificial Sequence: Synthetic peptide
  Seed: DEKVDELARFLLLKYQV (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLKYQV

SEQ ID NO: 256595 - protein, 17 aa, Artificial Sequence
  Description of Artificial Sequence: Synthetic peptide
  Seed: DEKVDELARFLLLKYQV (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKYQV

SEQ ID NO: 256596 - protein, 17 aa, Artificial Sequence
  Description of Artificial Sequence: Synthetic peptide
  Seed: DEKVDELARFLLLKYQV (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQV

SEQ ID NO: 256597 - protein, 17 aa, Artificial Sequence
  Description of Artificial Sequence: Synthetic peptide
  Seed: DEKVDELARFLLLKYQV (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQV

SEQ ID NO: 256598 - protein, 18 aa, Artificial Sequence
  Description of Artificial Sequence: Synthetic peptide
  Seed: DEKVDELARFLLLKYQVK (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLKYQVK

SEQ ID NO: 256599 - protein, 18 aa, Artificial Sequence
  Description of Artificial Sequence: Synthetic peptide
  Seed: DEKVDELARFLLLKYQVK (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVK

SEQ ID NO: 256600 - protein, 18 aa, Artificial Sequence
  Description of Artificial Sequence: Synthetic peptide
  Seed: DEKVDELARFLLLKYQVK (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVK

SEQ ID NO: 256601 - protein, 19 aa, Artificial Sequence
  Description of Artificial Sequence: Synthetic peptide
  Seed: DEKVDELARFLLLKYQVKQ (MAGC1_HUMAN)
  Core: KVDELARFL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXVDXLXRFXLLKYQVKQ

SEQ ID NO: 256602 - protein, 19 aa, Artificial Sequence
  Description of Artificial Sequence: Synthetic peptide
  Seed: DEKVDELARFLLLKYQVKQ (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKYQVKQ

SEQ ID NO: 256603 - protein, 19 aa, Artificial Sequence
  Description of Artificial Sequence: Synthetic peptide
  Seed: DEKVDELARFLLLKYQVKQ (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQ

SEQ ID NO: 256604 - protein, 19 aa, Artificial Sequence
  Description of Artificial Sequence: Synthetic peptide
  Seed: DEKVDELARFLLLKYQVKQ (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQ

SEQ ID NO: 256605 - protein, 19 aa, Artificial Sequence
  Description of Artificial Sequence: Synthetic peptide
  Seed: DEKVDELARFLLLKYQVKQ (MAGC1_HUMAN)
  Core: ARFLLLKYQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELXRFXLXKYXVKQ

SEQ ID NO: 256606 - protein, 19 aa, Artificial Sequence
  Description of Artificial Sequence: Synthetic peptide
  Seed: DEKVDELARFLLLKYQVKQ (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQ

SEQ ID NO: 256607 - protein, 20 aa, Artificial Sequence
  Description of Artificial Sequence: Synthetic peptide
  Seed: DEKVDELARFLLLKYQVKQP (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKYQVKQP

SEQ ID NO: 256608 - protein, 20 aa, Artificial Sequence
  Description of Artificial Sequence: Synthetic peptide
  Seed: DEKVDELARFLLLKYQVKQP (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQP

SEQ ID NO: 256609 - protein, 20 aa, Artificial Sequence
  Description of Artificial Sequence: Synthetic peptide
  Seed: DEKVDELARFLLLKYQVKQP (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQP

SEQ ID NO: 256610 - protein, 20 aa, Artificial Sequence
  Description of Artificial Sequence: Synthetic peptide
  Seed: DEKVDELARFLLLKYQVKQP (MAGC1_HUMAN)
  Core: ARFLLLKYQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELXRFXLXKYXVKQP

SEQ ID NO: 256611 - protein, 20 aa, Artificial Sequence
  Description of Artificial Sequence: Synthetic peptide
  Seed: DEKVDELARFLLLKYQVKQP (MAGC1_HUMAN)
  Core: RFLLLKYQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELAXFLXLXYQXKQP

SEQ ID NO: 256612 - protein, 20 aa, Artificial Sequence
  Description of Artificial Sequence: Synthetic peptide
  Seed: DEKVDELARFLLLKYQVKQP (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQP

SEQ ID NO: 256613 - protein, 20 aa, Artificial Sequence
  Description of Artificial Sequence: Synthetic peptide
  Seed: DEKVDELARFLLLKYQVKQP (MAGC1_HUMAN)
  Core: LLLKYQVKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFXLLXYXVKXP

SEQ ID NO: 256614 - protein, 21 aa, Artificial Sequence
  Description of Artificial Sequence: Synthetic peptide
  Seed: DEKVDELARFLLLKYQVKQPI (MAGC1_HUMAN)
  Core: VDELARFLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEKXDEXAXFLXLKYQVKQPI

SEQ ID NO: 256615 - protein, 21 aa, Artificial Sequence
  Description of Artificial Sequence: Synthetic peptide
  Seed: DEKVDELARFLLLKYQVKQPI (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQPI

SEQ ID NO: 256616 - protein, 21 aa, Artificial Sequence
  Description of Artificial Sequence: Synthetic peptide
  Seed: DEKVDELARFLLLKYQVKQPI (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQPI

SEQ ID NO: 256617 - protein, 21 aa, Artificial Sequence
  Description of Artificial Sequence: Synthetic peptide
  Seed: DEKVDELARFLLLKYQVKQPI (MAGC1_HUMAN)
  Core: ARFLLLKYQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELXRFXLXKYXVKQPI

SEQ ID NO: 256618 - protein, 21 aa, Artificial Sequence
  Description of Artificial Sequence: Synthetic peptide
  Seed: DEKVDELARFLLLKYQVKQPI (MAGC1_HUMAN)
  Core: RFLLLKYQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELAXFLXLXYQXKQPI

SEQ ID NO: 256619 - protein, 21 aa, Artificial Sequence
  Description of Artificial Sequence: Synthetic peptide
  Seed: DEKVDELARFLLLKYQVKQPI (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQPI

SEQ ID NO: 256620 - protein, 21 aa, Artificial Sequence
  Description of Artificial Sequence: Synthetic peptide
  Seed: DEKVDELARFLLLKYQVKQPI (MAGC1_HUMAN)
  Core: LLLKYQVKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFXLLXYXVKXPI

SEQ ID NO: 256621 - protein, 21 aa, Artificial Sequence
  Description of Artificial Sequence: Synthetic peptide
  Seed: DEKVDELARFLLLKYQVKQPI (MAGC1_HUMAN)
  Core: LKYQVKQPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLXKYXVXQPX

SEQ ID NO: 256622 - protein, 22 aa, Artificial Sequence
  Description of Artificial Sequence: Synthetic peptide
  Seed: DEKVDELARFLLLKYQVKQPIT (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQPIT

SEQ ID NO: 256623 - protein, 22 aa, Artificial Sequence
  Description of Artificial Sequence: Synthetic peptide
  Seed: DEKVDELARFLLLKYQVKQPIT (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQPIT

SEQ ID NO: 256624 - protein, 22 aa, Artificial Sequence
  Description of Artificial Sequence: Synthetic peptide
  Seed: DEKVDELARFLLLKYQVKQPIT (MAGC1_HUMAN)
  Core: ARFLLLKYQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELXRFXLXKYXVKQPIT

SEQ ID NO: 256625 - protein, 22 aa, Artificial Sequence
  Description of Artificial Sequence: Synthetic peptide
  Seed: DEKVDELARFLLLKYQVKQPIT (MAGC1_HUMAN)
  Core: RFLLLKYQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELAXFLXLXYQXKQPIT

SEQ ID NO: 256626 - protein, 22 aa, Artificial Sequence
  Description of Artificial Sequence: Synthetic peptide
  Seed: DEKVDELARFLLLKYQVKQPIT (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQPIT

SEQ ID NO: 256627 - protein, 22 aa, Artificial Sequence
  Description of Artificial Sequence: Synthetic peptide
  Seed: DEKVDELARFLLLKYQVKQPIT (MAGC1_HUMAN)
  Core: LLLKYQVKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFXLLXYXVKXPIT

SEQ ID NO: 256628 - protein, 22 aa, Artificial Sequence
  Description of Artificial Sequence: Synthetic peptide
  Seed: DEKVDELARFLLLKYQVKQPIT (MAGC1_HUMAN)
  Core: LKYQVKQPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLXKYXVXQPXT

SEQ ID NO: 256629 - protein, 23 aa, Artificial Sequence
  Description of Artificial Sequence: Synthetic peptide
  Seed: DEKVDELARFLLLKYQVKQPITK (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQPITK

SEQ ID NO: 256630 - protein, 23 aa, Artificial Sequence
  Description of Artificial Sequence: Synthetic peptide
  Seed: DEKVDELARFLLLKYQVKQPITK (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQPITK

SEQ ID NO: 256631 - protein, 23 aa, Artificial Sequence
  Description of Artificial Sequence: Synthetic peptide
  Seed: DEKVDELARFLLLKYQVKQPITK (MAGC1_HUMAN)
  Core: RFLLLKYQV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELAXFLXLXYQXKQPITK

SEQ ID NO: 256632 - protein, 23 aa, Artificial Sequence
  Description of Artificial Sequence: Synthetic peptide
  Seed: DEKVDELARFLLLKYQVKQPITK (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQPITK

SEQ ID NO: 256633 - protein, 23 aa, Artificial Sequence
  Description of Artificial Sequence: Synthetic peptide
  Seed: DEKVDELARFLLLKYQVKQPITK (MAGC1_HUMAN)
  Core: LLLKYQVKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFXLLXYXVKXPITK

SEQ ID NO: 256634 - protein, 23 aa, Artificial Sequence
  Description of Artificial Sequence: Synthetic peptide
  Seed: DEKVDELARFLLLKYQVKQPITK (MAGC1_HUMAN)
  Core: LLKYQVKQP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLXLKXQXKQXITK

SEQ ID NO: 256635 - protein, 23 aa, Artificial Sequence
  Description of Artificial Sequence: Synthetic peptide
  Seed: DEKVDELARFLLLKYQVKQPITK (MAGC1_HUMAN)
  Core: LKYQVKQPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLXKYXVXQPXTK

SEQ ID NO: 256636 - protein, 24 aa, Artificial Sequence
  Description of Artificial Sequence: Synthetic peptide
  Seed: DEKVDELARFLLLKYQVKQPITKA (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQPITKA

SEQ ID NO: 256637 - protein, 24 aa, Artificial Sequence
  Description of Artificial Sequence: Synthetic peptide
  Seed: DEKVDELARFLLLKYQVKQPITKA (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQPITKA

SEQ ID NO: 256638 - protein, 24 aa, Artificial Sequence
  Description of Artificial Sequence: Synthetic peptide
  Seed: DEKVDELARFLLLKYQVKQPITKA (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQPITKA

SEQ ID NO: 256639 - protein, 24 aa, Artificial Sequence
  Description of Artificial Sequence: Synthetic peptide
  Seed: DEKVDELARFLLLKYQVKQPITKA (MAGC1_HUMAN)
  Core: LLKYQVKQP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLXLKXQXKQXITKA

SEQ ID NO: 256640 - protein, 24 aa, Artificial Sequence
  Description of Artificial Sequence: Synthetic peptide
  Seed: DEKVDELARFLLLKYQVKQPITKA (MAGC1_HUMAN)
  Core: LKYQVKQPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLXKYXVXQPXTKA

SEQ ID NO: 256641 - protein, 24 aa, Artificial Sequence
  Description of Artificial Sequence: Synthetic peptide
  Seed: DEKVDELARFLLLKYQVKQPITKA (MAGC1_HUMAN)
  Core: YQVKQPITK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLLKXQVXQXITXA

SEQ ID NO: 256642 - protein, 25 aa, Artificial Sequence
  Description of Artificial Sequence: Synthetic peptide
  Seed: DEKVDELARFLLLKYQVKQPITKAE (MAGC1_HUMAN)
  Core: DELARFLLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEKVXELXRXLLXKYQVKQPITKAE

SEQ ID NO: 256643 - protein, 25 aa, Artificial Sequence
  Description of Artificial Sequence: Synthetic peptide
  Seed: DEKVDELARFLLLKYQVKQPITKAE (MAGC1_HUMAN)
  Core: LARFLLLKY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDEXARXLXLKXQVKQPITKAE

SEQ ID NO: 256644 - protein, 25 aa, Artificial Sequence
  Description of Artificial Sequence: Synthetic peptide
  Seed: DEKVDELARFLLLKYQVKQPITKAE (MAGC1_HUMAN)
  Core: FLLLKYQVK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARXLLXKXQVXQPITKAE

SEQ ID NO: 256645 - protein, 25 aa, Artificial Sequence
  Description of Artificial Sequence: Synthetic peptide
  Seed: DEKVDELARFLLLKYQVKQPITKAE (MAGC1_HUMAN)
  Core: LLKYQVKQP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLXLKXQXKQXITKAE

SEQ ID NO: 256646 - protein, 25 aa, Artificial Sequence
  Description of Artificial Sequence: Synthetic peptide
  Seed: DEKVDELARFLLLKYQVKQPITKAE (MAGC1_HUMAN)
  Core: LKYQVKQPI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLXKYXVXQPXTKAE

SEQ ID NO: 256647 - protein, 25 aa, Artificial Sequence
  Description of Artificial Sequence: Synthetic peptide
  Seed: DEKVDELARFLLLKYQVKQPITKAE (MAGC1_HUMAN)
  Core: YQVKQPITK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DEKVDELARFLLLKXQVXQXITXAE

SEQ ID NO: 256648 - protein, 13 aa, Artificial Sequence
  Description of Artificial Sequence: Synthetic peptide
  Seed: DELARFLLLKYQV (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQV

SEQ ID NO: 256649 - protein, 14 aa, Artificial Sequence
  Description of Artificial Sequence: Synthetic peptide
  Seed: DELARFLLLKYQVK (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQVK

SEQ ID NO: 256650 - protein, 14 aa, Artificial Sequence
  Description of Artificial Sequence: Synthetic peptide
  Seed: DELARFLLLKYQVK (MAGC1_HUMAN)
  Core: ARFLLLKYQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXRFXLXKYXVK

SEQ ID NO: 256651 - protein, 14 aa, Artificial Sequence
  Description of Artificial Sequence: Synthetic peptide
  Seed: DELARFLLLKYQVK (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVX

SEQ ID NO: 256652 - protein, 15 aa, Artificial Sequence
  Description of Artificial Sequence: Synthetic peptide
  Seed: DELARFLLLKYQVKQ (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQVKQ

SEQ ID NO: 256653 - protein, 15 aa, Artificial Sequence
  Description of Artificial Sequence: Synthetic peptide
  Seed: DELARFLLLKYQVKQ (MAGC1_HUMAN)
  Core: ARFLLLKYQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXRFXLXKYXVKQ

SEQ ID NO: 256654 - protein, 15 aa, Artificial Sequence
  Description of Artificial Sequence: Synthetic peptide
  Seed: DELARFLLLKYQVKQ (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQ

SEQ ID NO: 256655 - protein, 15 aa, Artificial Sequence
  Description of Artificial Sequence: Synthetic peptide
  Seed: DELARFLLLKYQVKQ (MAGC1_HUMAN)
  Core: LLLKYQVKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELARFXLLXYXVKX

SEQ ID NO: 256656 - protein, 16 aa, Artificial Sequence
  Description of Artificial Sequence: Synthetic peptide
  Seed: DELARFLLLKYQVKQP (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQVKQP

SEQ ID NO: 256657 - protein, 16 aa, Artificial Sequence
  Description of Artificial Sequence: Synthetic peptide
  Seed: DELARFLLLKYQVKQP (MAGC1_HUMAN)
  Core: ARFLLLKYQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DELXRFXLXKYXVKQP

SEQ ID NO: 256658 - protein, 16 aa, Artificial Sequence
  Description of Artificial Sequence: Synthetic peptide
  Seed: DELARFLLLKYQVKQP (MAGC1_HUMAN)
  Core: RFLLLKYQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DELAXFLXLXYQXKQP

SEQ ID NO: 256659 - protein, 16 aa, Artificial Sequence
  Description of Artificial Sequence: Synthetic peptide
  Seed: DELARFLLLKYQVKQP (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQP

SEQ ID NO: 256660 - protein, 16 aa, Artificial Sequence
  Description of Artificial Sequence: Synthetic peptide
  Seed: DELARFLLLKYQVKQP (MAGC1_HUMAN)
  Core: LLLKYQVKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELARFXLLXYXVKXP

SEQ ID NO: 256661 - protein, 17 aa, Artificial Sequence
  Description of Artificial Sequence: Synthetic peptide
  Seed: DELARFLLLKYQVKQPI (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQVKQPI

SEQ ID NO: 256662 - protein, 17 aa, Artificial Sequence
  Description of Artificial Sequence: Synthetic peptide
  Seed: DELARFLLLKYQVKQPI (MAGC1_HUMAN)
  Core: RFLLLKYQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DELAXFLXLXYQXKQPI

SEQ ID NO: 256663 - protein, 17 aa, Artificial Sequence
  Description of Artificial Sequence: Synthetic peptide
  Seed: DELARFLLLKYQVKQPI (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPI

SEQ ID NO: 256664 - protein, 17 aa, Artificial Sequence
  Description of Artificial Sequence: Synthetic peptide
  Seed: DELARFLLLKYQVKQPI (MAGC1_HUMAN)
  Core: LLLKYQVKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELARFXLLXYXVKXPI

SEQ ID NO: 256665 - protein, 17 aa, Artificial Sequence
  Description of Artificial Sequence: Synthetic peptide
  Seed: DELARFLLLKYQVKQPI (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPX

SEQ ID NO: 256666 - protein, 18 aa, Artificial Sequence
  Description of Artificial Sequence: Synthetic peptide
  Seed: DELARFLLLKYQVKQPIT (MAGC1_HUMAN)
  Core: LARFLLLKY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXARXLXLKXQVKQPIT

SEQ ID NO: 256667 - protein, 18 aa, Artificial Sequence
  Description of Artificial Sequence: Synthetic peptide
  Seed: DELARFLLLKYQVKQPIT (MAGC1_HUMAN)
  Core: RFLLLKYQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DELAXFLXLXYQXKQPIT

SEQ ID NO: 256668 - protein, 18 aa, Artificial Sequence
  Description of Artificial Sequence: Synthetic peptide
  Seed: DELARFLLLKYQVKQPIT (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPIT

SEQ ID NO: 256669 - protein, 18 aa, Artificial Sequence
  Description of Artificial Sequence: Synthetic peptide
  Seed: DELARFLLLKYQVKQPIT (MAGC1_HUMAN)
  Core: LLLKYQVKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELARFXLLXYXVKXPIT

SEQ ID NO: 256670 - protein, 18 aa, Artificial Sequence
  Description of Artificial Sequence: Synthetic peptide
  Seed: DELARFLLLKYQVKQPIT (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXIT

SEQ ID NO: 256671 - protein, 18 aa, Artificial Sequence
  Description of Artificial Sequence: Synthetic peptide
  Seed: DELARFLLLKYQVKQPIT (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXT

SEQ ID NO: 256672 - protein, 19 aa, Artificial Sequence
  Description of Artificial Sequence: Synthetic peptide
  Seed: DELARFLLLKYQVKQPITK (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITK

SEQ ID NO: 256673 - protein, 19 aa, Artificial Sequence
  Description of Artificial Sequence: Synthetic peptide
  Seed: DELARFLLLKYQVKQPITK (MAGC1_HUMAN)
  Core: LLLKYQVKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DELARFXLLXYXVKXPITK

SEQ ID NO: 256674 - protein, 19 aa, Artificial Sequence
  Description of Artificial Sequence: Synthetic peptide
  Seed: DELARFLLLKYQVKQPITK (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITK

SEQ ID NO: 256675 - protein, 19 aa, Artificial Sequence
  Description of Artificial Sequence: Synthetic peptide
  Seed: DELARFLLLKYQVKQPITK (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTK

SEQ ID NO: 256676 - protein, 20 aa, Artificial Sequence
  Description of Artificial Sequence: Synthetic peptide
  Seed: DELARFLLLKYQVKQPITKA (MAGC1_HUMAN)
  Core: RFLLLKYQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DELAXFLXLXYQXKQPITKA

SEQ ID NO: 256677 - protein, 20 aa, Artificial Sequence
  Description of Artificial Sequence: Synthetic peptide
  Seed: DELARFLLLKYQVKQPITKA (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKA

SEQ ID NO: 256678 - protein, 20 aa, Artificial Sequence
  Description of Artificial Sequence: Synthetic peptide
  Seed: DELARFLLLKYQVKQPITKA (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKA

SEQ ID NO: 256679 - protein, 20 aa, Artificial Sequence
  Description of Artificial Sequence: Synthetic peptide
  Seed: DELARFLLLKYQVKQPITKA (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKA

SEQ ID NO: 256680 - protein, 20 aa, Artificial Sequence
  Description of Artificial Sequence: Synthetic peptide
  Seed: DELARFLLLKYQVKQPITKA (MAGC1_HUMAN)
  Core: KYQVKQPIT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLXYQXKXPIXKA

SEQ ID NO: 256681 - protein, 20 aa, Artificial Sequence
  Description of Artificial Sequence: Synthetic peptide
  Seed: DELARFLLLKYQVKQPITKA (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXA

SEQ ID NO: 256682 - protein, 21 aa, Artificial Sequence
  Description of Artificial Sequence: Synthetic peptide
  Seed: DELARFLLLKYQVKQPITKAE (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKAE

SEQ ID NO: 256683 - protein, 21 aa, Artificial Sequence
  Description of Artificial Sequence: Synthetic peptide
  Seed: DELARFLLLKYQVKQPITKAE (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKAE

SEQ ID NO: 256684 - protein, 21 aa, Artificial Sequence
  Description of Artificial Sequence: Synthetic peptide
  Seed: DELARFLLLKYQVKQPITKAE (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKAE

SEQ ID NO: 256685 - protein, 21 aa, Artificial Sequence
  Description of Artificial Sequence: Synthetic peptide
  Seed: DELARFLLLKYQVKQPITKAE (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXAE

SEQ ID NO: 256686 - protein, 22 aa, Artificial Sequence
  Description of Artificial Sequence: Synthetic peptide
  Seed: DELARFLLLKYQVKQPITKAEM (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKAEM

SEQ ID NO: 256687 - protein, 22 aa, Artificial Sequence
  Description of Artificial Sequence: Synthetic peptide
  Seed: DELARFLLLKYQVKQPITKAEM (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKAEM

SEQ ID NO: 256688 - protein, 22 aa, Artificial Sequence
  Description of Artificial Sequence: Synthetic peptide
  Seed: DELARFLLLKYQVKQPITKAEM (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKAEM

SEQ ID NO: 256689 - protein, 22 aa, Artificial Sequence
  Description of Artificial Sequence: Synthetic peptide
  Seed: DELARFLLLKYQVKQPITKAEM (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXAEM

SEQ ID NO: 256690 - protein, 23 aa, Artificial Sequence
  Description of Artificial Sequence: Synthetic peptide
  Seed: DELARFLLLKYQVKQPITKAEML (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKAEML

SEQ ID NO: 256691 - protein, 23 aa, Artificial Sequence
  Description of Artificial Sequence: Synthetic peptide
  Seed: DELARFLLLKYQVKQPITKAEML (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKAEML

SEQ ID NO: 256692 - protein, 23 aa, Artificial Sequence
  Description of Artificial Sequence: Synthetic peptide
  Seed: DELARFLLLKYQVKQPITKAEML (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKAEML

SEQ ID NO: 256693 - protein, 23 aa, Artificial Sequence
  Description of Artificial Sequence: Synthetic peptide
  Seed: DELARFLLLKYQVKQPITKAEML (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXAEML

SEQ ID NO: 256694 - protein, 24 aa, Artificial Sequence
  Description of Artificial Sequence: Synthetic peptide
  Seed: DELARFLLLKYQVKQPITKAEMLT (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKAEMLT

SEQ ID NO: 256695 - protein, 24 aa, Artificial Sequence
  Description of Artificial Sequence: Synthetic peptide
  Seed: DELARFLLLKYQVKQPITKAEMLT (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKAEMLT

SEQ ID NO: 256696 - protein, 24 aa, Artificial Sequence
  Description of Artificial Sequence: Synthetic peptide
  Seed: DELARFLLLKYQVKQPITKAEMLT (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKAEMLT

SEQ ID NO: 256697 - protein, 24 aa, Artificial Sequence
  Description of Artificial Sequence: Synthetic peptide
  Seed: DELARFLLLKYQVKQPITKAEMLT (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXAEMLT

SEQ ID NO: 256698 - protein, 25 aa, Artificial Sequence
  Description of Artificial Sequence: Synthetic peptide
  Seed: DELARFLLLKYQVKQPITKAEMLTN (MAGC1_HUMAN)
  Core: FLLLKYQVK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DELARXLLXKXQVXQPITKAEMLTN

SEQ ID NO: 256699 - protein, 25 aa, Artificial Sequence
  Description of Artificial Sequence: Synthetic peptide
  Seed: DELARFLLLKYQVKQPITKAEMLTN (MAGC1_HUMAN)
  Core: LLKYQVKQP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLXLKXQXKQXITKAEMLTN

SEQ ID NO: 256700 - protein, 25 aa, Artificial Sequence
  Description of Artificial Sequence: Synthetic peptide
  Seed: DELARFLLLKYQVKQPITKAEMLTN (MAGC1_HUMAN)
  Core: LKYQVKQPI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLXKYXVXQPXTKAEMLTN

SEQ ID NO: 256701 - protein, 25 aa, Artificial Sequence
  Description of Artificial Sequence: Synthetic peptide
  Seed: DELARFLLLKYQVKQPITKAEMLTN (MAGC1_HUMAN)
  Core: YQVKQPITK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKXQVXQXITXAEMLTN

SEQ ID NO: 256702 - protein, 25 aa, Artificial Sequence
  Description of Artificial Sequence: Synthetic peptide
  Seed: DELARFLLLKYQVKQPITKAEMLTN (MAGC1_HUMAN)
  Core: KQPITKAEM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DELARFLLLKYQVXQPXTXAEXLTN

SEQ ID NO: 256703 - protein, 13 aa, Artificial Sequence
  Description of Artificial Sequence: Synthetic peptide
  Seed: DEQGMSQNRLLIL (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIX

SEQ ID NO: 256704 - protein, 14 aa, Artificial Sequence
  Description of Artificial Sequence: Synthetic peptide
  Seed: DEQGMSQNRLLILI (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXI

SEQ ID NO: 256705 - protein, 15 aa, Artificial Sequence
  Description of Artificial Sequence: Synthetic peptide
  Seed: DEQGMSQNRLLILIL (MAGC1_HUMAN)
  Core: QGMSQNRLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXGMXQXRLXILIL

SEQ ID NO: 256706 - protein, 15 aa, Artificial Sequence
  Description of Artificial Sequence: Synthetic peptide
  Seed: DEQGMSQNRLLILIL (MAGC1_HUMAN)
  Core: GMSQNRLLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DEQXMSXNXLLXLIL

SEQ ID NO: 256707 - protein, 15 aa, Artificial Sequence
  Description of Artificial Sequence: Synthetic peptide
  Seed: DEQGMSQNRLLILIL (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXIL

SEQ ID NO: 256708 - protein, 16 aa, Artificial Sequence
  Description of Artificial Sequence: Synthetic peptide
  Seed: DEQGMSQNRLLILILS (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILS

SEQ ID NO: 256709 - protein, 17 aa, Artificial Sequence
  Description of Artificial Sequence: Synthetic peptide
  Seed: DEQGMSQNRLLILILSI (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSI

SEQ ID NO: 256710 - protein, 17 aa, Artificial Sequence
  Description of Artificial Sequence: Synthetic peptide
  Seed: DEQGMSQNRLLILILSI (MAGC1_HUMAN)
  Core: RLLILILSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNXLLXLXLSX

SEQ ID NO: 256711 - protein, 18 aa, Artificial Sequence
  Description of Artificial Sequence: Synthetic peptide
  Seed: DEQGMSQNRLLILILSII (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSII

SEQ ID NO: 256712 - protein, 18 aa, Artificial Sequence
  Description of Artificial Sequence: Synthetic peptide
  Seed: DEQGMSQNRLLILILSII (MAGC1_HUMAN)
  Core: RLLILILSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNXLLXLXLSXI

SEQ ID NO: 256713 - protein, 19 aa, Artificial Sequence
  Description of Artificial Sequence: Synthetic peptide
  Seed: DEQGMSQNRLLILILSIIF (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIF

SEQ ID NO: 256714 - protein, 19 aa, Artificial Sequence
  Description of Artificial Sequence: Synthetic peptide
  Seed: DEQGMSQNRLLILILSIIF (MAGC1_HUMAN)
  Core: RLLILILSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNXLLXLXLSXIF

SEQ ID NO: 256715 - protein, 20 aa, Artificial Sequence
  Description of Artificial Sequence: Synthetic peptide
  Seed: DEQGMSQNRLLILILSIIFI (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFI

SEQ ID NO: 256716 - protein, 20 aa, Artificial Sequence
  Description of Artificial Sequence: Synthetic peptide
  Seed: DEQGMSQNRLLILILSIIFI (MAGC1_HUMAN)
  Core: RLLILILSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNXLLXLXLSXIFI

SEQ ID NO: 256717 - protein, 21 aa, Artificial Sequence
  Description of Artificial Sequence: Synthetic peptide
  Seed: DEQGMSQNRLLILILSIIFIK (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFIK

SEQ ID NO: 256718 - protein, 21 aa, Artificial Sequence
  Description of Artificial Sequence: Synthetic peptide
  Seed: DEQGMSQNRLLILILSIIFIK (MAGC1_HUMAN)
  Core: RLLILILSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNXLLXLXLSXIFIK

SEQ ID NO: 256719 - protein, 21 aa, Artificial Sequence
  Description of Artificial Sequence: Synthetic peptide
  Seed: DEQGMSQNRLLILILSIIFIK (MAGC1_HUMAN)
  Core: LLILILSII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRXLIXIXSIXFIK

SEQ ID NO: 256720 - protein, 22 aa, Artificial Sequence
  Description of Artificial Sequence: Synthetic peptide
  Seed: DEQGMSQNRLLILILSIIFIKG (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFIKG

SEQ ID NO: 256721 - protein, 22 aa, Artificial Sequence
  Description of Artificial Sequence: Synthetic peptide
  Seed: DEQGMSQNRLLILILSIIFIKG (MAGC1_HUMAN)
  Core: LLILILSII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRXLIXIXSIXFIKG

SEQ ID NO: 256722 - protein, 22 aa, Artificial Sequence
  Description of Artificial Sequence: Synthetic peptide
  Seed: DEQGMSQNRLLILILSIIFIKG (MAGC1_HUMAN)
  Core: ILILSIIFI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLXLIXSXIFXKG

SEQ ID NO: 256723 - protein, 23 aa, Artificial Sequence
  Description of Artificial Sequence: Synthetic peptide
  Seed: DEQGMSQNRLLILILSIIFIKGT (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFIKGT

SEQ ID NO: 256724 - protein, 23 aa, Artificial Sequence
  Description of Artificial Sequence: Synthetic peptide
  Seed: DEQGMSQNRLLILILSIIFIKGT (MAGC1_HUMAN)
  Core: LLILILSII
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRXLIXIXSIXFIKGT

SEQ ID NO: 256725 - protein, 23 aa, Artificial Sequence
  Description of Artificial Sequence: Synthetic peptide
  Seed: DEQGMSQNRLLILILSIIFIKGT (MAGC1_HUMAN)
  Core: ILILSIIFI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLXLIXSXIFXKGT

SEQ ID NO: 256726 - protein, 24 aa, Artificial Sequence
  Description of Artificial Sequence: Synthetic peptide
  Seed: DEQGMSQNRLLILILSIIFIKGTY (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFIKGTY

SEQ ID NO: 256727 - protein, 24 aa, Artificial Sequence
  Description of Artificial Sequence: Synthetic peptide
  Seed: DEQGMSQNRLLILILSIIFIKGTY (MAGC1_HUMAN)
  Core: ILILSIIFI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLXLIXSXIFXKGTY

SEQ ID NO: 256728 - protein, 24 aa, Artificial Sequence
  Description of Artificial Sequence: Synthetic peptide
  Seed: DEQGMSQNRLLILILSIIFIKGTY (MAGC1_HUMAN)
  Core: ILSIIFIKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLILXLSXIXIKXTY

SEQ ID NO: 256729 - protein, 25 aa, Artificial Sequence
  Description of Artificial Sequence: Synthetic peptide
  Seed: DEQGMSQNRLLILILSIIFIKGTYA (MAGC1_HUMAN)
  Core: MSQNRLLIL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DEQGXSQXRXLIXILSIIFIKGTYA

SEQ ID NO: 256730 - protein, 25 aa, Artificial Sequence
  Description of Artificial Sequence: Synthetic peptide
  Seed: DEQGMSQNRLLILILSIIFIKGTYA (MAGC1_HUMAN)
  Core: ILILSIIFI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLXLIXSXIFXKGTYA

SEQ ID NO: 256731 - protein, 25 aa, Artificial Sequence
  Description of Artificial Sequence: Synthetic peptide
  Seed: DEQGMSQNRLLILILSIIFIKGTYA (MAGC1_HUMAN)
  Core: ILSIIFIKG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DEQGMSQNRLLILXLSXIXIKXTYA

SEQ ID NO: 256732 - protein, 15 aa, Artificial Sequence
  Description of Artificial Sequence: Synthetic peptide
  Seed: DEYTSSSDTLLESDS (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDS

SEQ ID NO: 256733 - protein, 16 aa, Artificial Sequence
  Description of Artificial Sequence: Synthetic peptide
  Seed: DEYTSSSDTLLESDSL (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSL

SEQ ID NO: 256734 - protein, 19 aa, Artificial Sequence
  Description of Artificial Sequence: Synthetic peptide
  Seed: DEYTSSSDTLLESDSLTDS (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDS

SEQ ID NO: 256735 - protein, 20 aa, Artificial Sequence
  Description of Artificial Sequence: Synthetic peptide
  Seed: DEYTSSSDTLLESDSLTDSE (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDSE

SEQ ID NO: 256736 - protein, 20 aa, Artificial Sequence
  Description of Artificial Sequence: Synthetic peptide
  Seed: DEYTSSSDTLLESDSLTDSE (MAGC1_HUMAN)
  Core: LLESDSLTD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DEYTSSSDTXLEXDXLTXSE

SEQ ID NO: 256737 - protein, 22 aa, Artificial Sequence
  Description of Artificial Sequence: Synthetic peptide
  Seed: DEYTSSSDTLLESDSLTDSESL (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDSESL

SEQ ID NO: 256738 - protein, 23 aa, Artificial Sequence
  Description of Artificial Sequence: Synthetic peptide
  Seed: DEYTSSSDTLLESDSLTDSESLI (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDSESLI

SEQ ID NO: 256739 - protein, 24 aa, Artificial Sequence
  Description of Artificial Sequence: Synthetic peptide
  Seed: DEYTSSSDTLLESDSLTDSESLIE (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDSESLIE

SEQ ID NO: 256740 - protein, 25 aa, Artificial Sequence
  Description of Artificial Sequence: Synthetic peptide
  Seed: DEYTSSSDTLLESDSLTDSESLIES (MAGC1_HUMAN)
  Core: YTSSSDTLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DEXTSXSXTLXESDSLTDSESLIES

SEQ ID NO: 256741 - protein, 14 aa, Artificial Sequence
  Description of Artificial Sequence: Synthetic peptide
  Seed: DFQSSLQSPVSICS (MAGC1_HUMAN)
  Core: FQSSLQSPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXQSXLXSPXSICS

SEQ ID NO: 256742 - protein, 15 aa, Artificial Sequence
  Description of Artificial Sequence: Synthetic peptide
  Seed: DFQSSLQSPVSICSS (MAGC1_HUMAN)
  Core: FQSSLQSPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXQSXLXSPXSICSS

SEQ ID NO: 256743 - protein, 15 aa, Artificial Sequence
  Description of Artificial Sequence: Synthetic peptide
  Seed: DFQSSLQSPVSICSS (MAGC1_HUMAN)
  Core: SLQSPVSIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFQSXLQXPXSIXSS

SEQ ID NO: 256744 - protein, 15 aa, Artificial Sequence
  Description of Artificial Sequence: Synthetic peptide
  Seed: DFQSSLQSPVSICSS (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXS

SEQ ID NO: 256745 - protein, 15 aa, Artificial Sequence
  Description of Artificial Sequence: Synthetic peptide
  Seed: DFQSSLQSPVSICSS (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSX

SEQ ID NO: 256746 - protein, 16 aa, Artificial Sequence
  Description of Artificial Sequence: Synthetic peptide
  Seed: DFQSSLQSPVSICSSS (MAGC1_HUMAN)
  Core: FQSSLQSPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXQSXLXSPXSICSSS

SEQ ID NO: 256747 - protein, 16 aa, Artificial Sequence
  Description of Artificial Sequence: Synthetic peptide
  Seed: DFQSSLQSPVSICSSS (MAGC1_HUMAN)
  Core: SLQSPVSIC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DFQSXLQXPXSIXSSS

SEQ ID NO: 256748 - protein, 16 aa, Artificial Sequence
  Description of Artificial Sequence: Synthetic peptide
  Seed: DFQSSLQSPVSICSSS (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSS

SEQ ID NO: 256749 - protein, 16 aa, Artificial Sequence
  Description of Artificial Sequence: Synthetic peptide
  Seed: DFQSSLQSPVSICSSS (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXS

SEQ ID NO: 256750 - protein, 17 aa, Artificial Sequence
  Description of Artificial Sequence: Synthetic peptide
  Seed: DFQSSLQSPVSICSSST (MAGC1_HUMAN)
  Core: FQSSLQSPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXQSXLXSPXSICSSST

SEQ ID NO: 256751 - protein, 17 aa, Artificial Sequence
  Description of Artificial Sequence: Synthetic peptide
  Seed: DFQSSLQSPVSICSSST (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSST

SEQ ID NO: 256752 - protein, 17 aa, Artificial Sequence
  Description of Artificial Sequence: Synthetic peptide
  Seed: DFQSSLQSPVSICSSST (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXST

SEQ ID NO: 256753 - protein, 19 aa, Artificial Sequence
  Description of Artificial Sequence: Synthetic peptide
  Seed: DFQSSLQSPVSICSSSTSL (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSL

SEQ ID NO: 256754 - protein, 20 aa, Artificial Sequence
  Description of Artificial Sequence: Synthetic peptide
  Seed: DFQSSLQSPVSICSSSTSLS (MAGC1_HUMAN)
  Core: FQSSLQSPV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXQSXLXSPXSICSSSTSLS

SEQ ID NO: 256755 - protein, 20 aa, Artificial Sequence
  Description of Artificial Sequence: Synthetic peptide
  Seed: DFQSSLQSPVSICSSSTSLS (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLS

SEQ ID NO: 256756 - protein, 20 aa, Artificial Sequence
  Description of Artificial Sequence: Synthetic peptide
  Seed: DFQSSLQSPVSICSSSTSLS (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSLS

SEQ ID NO: 256757 - protein, 20 aa, Artificial Sequence
  Description of Artificial Sequence: Synthetic peptide
  Seed: DFQSSLQSPVSICSSSTSLS (MAGC1_HUMAN)
  Core: VSICSSSTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPXSIXSXSTXLS

SEQ ID NO: 256758 - protein, 20 aa, Artificial Sequence
  Description of Artificial Sequence: Synthetic peptide
  Seed: DFQSSLQSPVSICSSSTSLS (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLX

SEQ ID NO: 256759 - protein, 21 aa, Artificial Sequence
  Description of Artificial Sequence: Synthetic peptide
  Seed: DFQSSLQSPVSICSSSTSLSL (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLSL

SEQ ID NO: 256760 - protein, 21 aa, Artificial Sequence
  Description of Artificial Sequence: Synthetic peptide
  Seed: DFQSSLQSPVSICSSSTSLSL (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSLSL

SEQ ID NO: 256761 - protein, 21 aa, Artificial Sequence
  Description of Artificial Sequence: Synthetic peptide
  Seed: DFQSSLQSPVSICSSSTSLSL (MAGC1_HUMAN)
  Core: VSICSSSTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPXSIXSXSTXLSL

SEQ ID NO: 256762 - protein, 21 aa, Artificial Sequence
  Description of Artificial Sequence: Synthetic peptide
  Seed: DFQSSLQSPVSICSSSTSLSL (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLXL

SEQ ID NO: 256763 - protein, 22 aa, Artificial Sequence
  Description of Artificial Sequence: Synthetic peptide
  Seed: DFQSSLQSPVSICSSSTSLSLP (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLSLP

SEQ ID NO: 256764 - protein, 22 aa, Artificial Sequence
  Description of Artificial Sequence: Synthetic peptide
  Seed: DFQSSLQSPVSICSSSTSLSLP (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSLSLP

SEQ ID NO: 256765 - protein, 22 aa, Artificial Sequence
  Description of Artificial Sequence: Synthetic peptide
  Seed: DFQSSLQSPVSICSSSTSLSLP (MAGC1_HUMAN)
  Core: VSICSSSTS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPXSIXSXSTXLSLP

SEQ ID NO: 256766 - protein, 22 aa, Artificial Sequence
  Description of Artificial Sequence: Synthetic peptide
  Seed: DFQSSLQSPVSICSSSTSLSLP (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLXLP

SEQ ID NO: 256767 - protein, 22 aa, Artificial Sequence
  Description of Artificial Sequence: Synthetic peptide
  Seed: DFQSSLQSPVSICSSSTSLSLP (MAGC1_HUMAN)
  Core: CSSSTSLSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSIXSSXTXLSXP

SEQ ID NO: 256768 - protein, 23 aa, Artificial Sequence
  Description of Artificial Sequence: Synthetic peptide
  Seed: DFQSSLQSPVSICSSSTSLSLPQ (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLSLPQ

SEQ ID NO: 256769 - protein, 23 aa, Artificial Sequence
  Description of Artificial Sequence: Synthetic peptide
  Seed: DFQSSLQSPVSICSSSTSLSLPQ (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLXLPQ

SEQ ID NO: 256770 - protein, 23 aa, Artificial Sequence
  Description of Artificial Sequence: Synthetic peptide
  Seed: DFQSSLQSPVSICSSSTSLSLPQ (MAGC1_HUMAN)
  Core: CSSSTSLSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSIXSSXTXLSXPQ

SEQ ID NO: 256771 - protein, 24 aa, Artificial Sequence
  Description of Artificial Sequence: Synthetic peptide
  Seed: DFQSSLQSPVSICSSSTSLSLPQS (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLSLPQS

SEQ ID NO: 256772 - protein, 24 aa, Artificial Sequence
  Description of Artificial Sequence: Synthetic peptide
  Seed: DFQSSLQSPVSICSSSTSLSLPQS (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSLSLPQS

SEQ ID NO: 256773 - protein, 24 aa, Artificial Sequence
  Description of Artificial Sequence: Synthetic peptide
  Seed: DFQSSLQSPVSICSSSTSLSLPQS (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLXLPQS

SEQ ID NO: 256774 - protein, 24 aa, Artificial Sequence
  Description of Artificial Sequence: Synthetic peptide
  Seed: DFQSSLQSPVSICSSSTSLSLPQS (MAGC1_HUMAN)
  Core: CSSSTSLSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSIXSSXTXLSXPQS

SEQ ID NO: 256775 - protein, 25 aa, Artificial Sequence
  Description of Artificial Sequence: Synthetic peptide
  Seed: DFQSSLQSPVSICSSSTSLSLPQSF (MAGC1_HUMAN)
  Core: LQSPVSICS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSXQSXVXICXSSTSLSLPQSF

SEQ ID NO: 256776 - protein, 25 aa, Artificial Sequence
  Description of Artificial Sequence: Synthetic peptide
  Seed: DFQSSLQSPVSICSSSTSLSLPQSF (MAGC1_HUMAN)
  Core: QSPVSICSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLXSPXSXCSXSTSLSLPQSF

SEQ ID NO: 256777 - protein, 25 aa, Artificial Sequence
  Description of Artificial Sequence: Synthetic peptide
  Seed: DFQSSLQSPVSICSSSTSLSLPQSF (MAGC1_HUMAN)
  Core: ICSSSTSLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSXCSXSXSLXLPQSF

SEQ ID NO: 256778 - protein, 25 aa, Artificial Sequence
  Description of Artificial Sequence: Synthetic peptide
  Seed: DFQSSLQSPVSICSSSTSLSLPQSF (MAGC1_HUMAN)
  Core: CSSSTSLSL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DFQSSLQSPVSIXSSXTXLSXPQSF

SEQ ID NO: 256779 - protein, 13 aa, Artificial Sequence
  Description of Artificial Sequence: Synthetic peptide
  Seed: DKDMPTAGMPSLL (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLX

SEQ ID NO: 256780 - protein, 14 aa, Artificial Sequence
  Description of Artificial Sequence: Synthetic peptide
  Seed: DKDMPTAGMPSLLQ (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQ

SEQ ID NO: 256781 - protein, 15 aa, Artificial Sequence
  Description of Artificial Sequence: Synthetic peptide
  Seed: DKDMPTAGMPSLLQS (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQS

SEQ ID NO: 256782 - protein, 16 aa, Artificial Sequence
  Description of Artificial Sequence: Synthetic peptide
  Seed: DKDMPTAGMPSLLQSS (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSS

SEQ ID NO: 256783 - protein, 17 aa, Artificial Sequence
  Description of Artificial Sequence: Synthetic peptide
  Seed: DKDMPTAGMPSLLQSSS (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSS

SEQ ID NO: 256784 - protein, 17 aa, Artificial Sequence
  Description of Artificial Sequence: Synthetic peptide
  Seed: DKDMPTAGMPSLLQSSS (MAGC1_HUMAN)
  Core: TAGMPSLLQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPXAGXPXLLXSSS

SEQ ID NO: 256785 - protein, 18 aa, Artificial Sequence
  Description of Artificial Sequence: Synthetic peptide
  Seed: DKDMPTAGMPSLLQSSSE (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSE

SEQ ID NO: 256786 - protein, 18 aa, Artificial Sequence
  Description of Artificial Sequence: Synthetic peptide
  Seed: DKDMPTAGMPSLLQSSSE (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSE

SEQ ID NO: 256787 - protein, 19 aa, Artificial Sequence
  Description of Artificial Sequence: Synthetic peptide
  Seed: DKDMPTAGMPSLLQSSSES (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSES

SEQ ID NO: 256788 - protein, 19 aa, Artificial Sequence
  Description of Artificial Sequence: Synthetic peptide
  Seed: DKDMPTAGMPSLLQSSSES (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSES

SEQ ID NO: 256789 - protein, 20 aa, Artificial Sequence
  Description of Artificial Sequence: Synthetic peptide
  Seed: DKDMPTAGMPSLLQSSSESP (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESP

SEQ ID NO: 256790 - protein, 20 aa, Artificial Sequence
  Description of Artificial Sequence: Synthetic peptide
  Seed: DKDMPTAGMPSLLQSSSESP (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESP

SEQ ID NO: 256791 - protein, 21 aa, Artificial Sequence
  Description of Artificial Sequence: Synthetic peptide
  Seed: DKDMPTAGMPSLLQSSSESPQ (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESPQ

SEQ ID NO: 256792 - protein, 21 aa, Artificial Sequence
  Description of Artificial Sequence: Synthetic peptide
  Seed: DKDMPTAGMPSLLQSSSESPQ (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESPQ

SEQ ID NO: 256793 - protein, 22 aa, Artificial Sequence
  Description of Artificial Sequence: Synthetic peptide
  Seed: DKDMPTAGMPSLLQSSSESPQS (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESPQS

SEQ ID NO: 256794 - protein, 22 aa, Artificial Sequence
  Description of Artificial Sequence: Synthetic peptide
  Seed: DKDMPTAGMPSLLQSSSESPQS (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESPQS

SEQ ID NO: 256795 - protein, 23 aa, Artificial Sequence
  Description of Artificial Sequence: Synthetic peptide
  Seed: DKDMPTAGMPSLLQSSSESPQSC (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESPQSC

SEQ ID NO: 256796 - protein, 23 aa, Artificial Sequence
  Description of Artificial Sequence: Synthetic peptide
  Seed: DKDMPTAGMPSLLQSSSESPQSC (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESPQSC

SEQ ID NO: 256797 - protein, 24 aa, Artificial Sequence
  Description of Artificial Sequence: Synthetic peptide
  Seed: DKDMPTAGMPSLLQSSSESPQSCP (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESPQSCP

SEQ ID NO: 256798 - protein, 24 aa, Artificial Sequence
  Description of Artificial Sequence: Synthetic peptide
  Seed: DKDMPTAGMPSLLQSSSESPQSCP (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESPQSCP

SEQ ID NO: 256799 - protein, 25 aa, Artificial Sequence
  Description of Artificial Sequence: Synthetic peptide
  Seed: DKDMPTAGMPSLLQSSSESPQSCPE (MAGC1_HUMAN)
  Core: PTAGMPSLL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DKDMXTAXMXSLXQSSSESPQSCPE

SEQ ID NO: 256800 - protein, 25 aa, Artificial Sequence
  Description of Artificial Sequence: Synthetic peptide
  Seed: DKDMPTAGMPSLLQSSSESPQSCPE (MAGC1_HUMAN)
  Core: GMPSLLQSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DKDMPTAXMPXLXQSXSESPQSCPE

SEQ ID NO: 256801 - protein, 22 aa, Artificial Sequence
  Description of Artificial Sequence: Synthetic peptide
  Seed: DLTSEGCLSDEQGMSQNRLLIL (MAGC1_HUMAN)
  Core: QGMSQNRLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEXGMXQXRLXIL

SEQ ID NO: 256802 - protein, 22 aa, Artificial Sequence
  Description of Artificial Sequence: Synthetic peptide
  Seed: DLTSEGCLSDEQGMSQNRLLIL (MAGC1_HUMAN)
  Core: MSQNRLLIL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEQGXSQXRXLIX

SEQ ID NO: 256803 - protein, 23 aa, Artificial Sequence
  Description of Artificial Sequence: Synthetic peptide
  Seed: DLTSEGCLSDEQGMSQNRLLILI (MAGC1_HUMAN)
  Core: MSQNRLLIL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEQGXSQXRXLIXI

SEQ ID NO: 256804 - protein, 24 aa, Artificial Sequence
  Description of Artificial Sequence: Synthetic peptide
  Seed: DLTSEGCLSDEQGMSQNRLLILIL (MAGC1_HUMAN)
  Core: QGMSQNRLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEXGMXQXRLXILIL

SEQ ID NO: 256805 - protein, 24 aa, Artificial Sequence
  Description of Artificial Sequence: Synthetic peptide
  Seed: DLTSEGCLSDEQGMSQNRLLILIL (MAGC1_HUMAN)
  Core: MSQNRLLIL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEQGXSQXRXLIXIL

SEQ ID NO: 256806 - protein, 25 aa, Artificial Sequence
  Description of Artificial Sequence: Synthetic peptide
  Seed: DLTSEGCLSDEQGMSQNRLLILILS (MAGC1_HUMAN)
  Core: QGMSQNRLL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEXGMXQXRLXILILS

SEQ ID NO: 256807 - protein, 25 aa, Artificial Sequence
  Description of Artificial Sequence: Synthetic peptide
  Seed: DLTSEGCLSDEQGMSQNRLLILILS (MAGC1_HUMAN)
  Core: MSQNRLLIL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DLTSEGCLSDEQGXSQXRXLIXILS

SEQ ID NO: 256808 - protein, 13 aa, Artificial Sequence
  Description of Artificial Sequence: Synthetic peptide
  Seed: DMPTAGMPSLLQS (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQS

SEQ ID NO: 256809 - protein, 14 aa, Artificial Sequence
  Description of Artificial Sequence: Synthetic peptide
  Seed: DMPTAGMPSLLQSS (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSS

SEQ ID NO: 256810 - protein, 14 aa, Artificial Sequence
  Description of Artificial Sequence: Synthetic peptide
  Seed: DMPTAGMPSLLQSS (MAGC1_HUMAN)
  Core: TAGMPSLLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DMPXAGXPXLLXSS

SEQ ID NO: 256811 - protein, 15 aa, Artificial Sequence
  Description of Artificial Sequence: Synthetic peptide
  Seed: DMPTAGMPSLLQSSS (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSS

SEQ ID NO: 256812 - protein, 15 aa, Artificial Sequence
  Description of Artificial Sequence: Synthetic peptide
  Seed: DMPTAGMPSLLQSSS (MAGC1_HUMAN)
  Core: TAGMPSLLQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DMPXAGXPXLLXSSS

SEQ ID NO: 256813 - protein, 15 aa, Artificial Sequence
  Description of Artificial Sequence: Synthetic peptide
  Seed: DMPTAGMPSLLQSSS (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXS

SEQ ID NO: 256814 - protein, 16 aa, Artificial Sequence
  Description of Artificial Sequence: Synthetic peptide
  Seed: DMPTAGMPSLLQSSSE (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSE

SEQ ID NO: 256815 - protein, 16 aa, Artificial Sequence
  Description of Artificial Sequence: Synthetic peptide
  Seed: DMPTAGMPSLLQSSSE (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSE

SEQ ID NO: 256816 - protein, 17 aa, Artificial Sequence
  Description of Artificial Sequence: Synthetic peptide
  Seed: DMPTAGMPSLLQSSSES (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSES

SEQ ID NO: 256817 - protein, 17 aa, Artificial Sequence
  Description of Artificial Sequence: Synthetic peptide
  Seed: DMPTAGMPSLLQSSSES (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSES

SEQ ID NO: 256818 - protein, 18 aa, Artificial Sequence
  Description of Artificial Sequence: Synthetic peptide
  Seed: DMPTAGMPSLLQSSSESP (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESP

SEQ ID NO: 256819 - protein, 19 aa, Artificial Sequence
  Description of Artificial Sequence: Synthetic peptide
  Seed: DMPTAGMPSLLQSSSESPQ (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQ

SEQ ID NO: 256820 - protein, 19 aa, Artificial Sequence
  Description of Artificial Sequence: Synthetic peptide
  Seed: DMPTAGMPSLLQSSSESPQ (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQ

SEQ ID NO: 256821 - protein, 20 aa, Artificial Sequence
  Description of Artificial Sequence: Synthetic peptide
  Seed: DMPTAGMPSLLQSSSESPQS (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQS

SEQ ID NO: 256822 - protein, 20 aa, Artificial Sequence
  Description of Artificial Sequence: Synthetic peptide
  Seed: DMPTAGMPSLLQSSSESPQS (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQS

SEQ ID NO: 256823 - protein, 21 aa, Artificial Sequence
  Description of Artificial Sequence: Synthetic peptide
  Seed: DMPTAGMPSLLQSSSESPQSC (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQSC

SEQ ID NO: 256824 - protein, 21 aa, Artificial Sequence
  Description of Artificial Sequence: Synthetic peptide
  Seed: DMPTAGMPSLLQSSSESPQSC (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQSC

SEQ ID NO: 256825 - protein, 22 aa, Artificial Sequence
  Description of Artificial Sequence: Synthetic peptide
  Seed: DMPTAGMPSLLQSSSESPQSCP (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQSCP

SEQ ID NO: 256826 - protein, 22 aa, Artificial Sequence
  Description of Artificial Sequence: Synthetic peptide
  Seed: DMPTAGMPSLLQSSSESPQSCP (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQSCP

SEQ ID NO: 256827 - protein, 23 aa, Artificial Sequence
  Description of Artificial Sequence: Synthetic peptide
  Seed: DMPTAGMPSLLQSSSESPQSCPE (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQSCPE

SEQ ID NO: 256828 - protein, 23 aa, Artificial Sequence
  Description of Artificial Sequence: Synthetic peptide
  Seed: DMPTAGMPSLLQSSSESPQSCPE (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQSCPE

SEQ ID NO: 256829 - protein, 24 aa, Artificial Sequence
  Description of Artificial Sequence: Synthetic peptide
  Seed: DMPTAGMPSLLQSSSESPQSCPEG (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQSCPEG

SEQ ID NO: 256830 - protein, 24 aa, Artificial Sequence
  Description of Artificial Sequence: Synthetic peptide
  Seed: DMPTAGMPSLLQSSSESPQSCPEG (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQSCPEG

SEQ ID NO: 256831 - protein, 25 aa, Artificial Sequence
  Description of Artificial Sequence: Synthetic peptide
  Seed: DMPTAGMPSLLQSSSESPQSCPEGE (MAGC1_HUMAN)
  Core: PTAGMPSLL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DMXTAXMXSLXQSSSESPQSCPEGE

SEQ ID NO: 256832 - protein, 25 aa, Artificial Sequence
  Description of Artificial Sequence: Synthetic peptide
  Seed: DMPTAGMPSLLQSSSESPQSCPEGE (MAGC1_HUMAN)
  Core: GMPSLLQSS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DMPTAXMPXLXQSXSESPQSCPEGE

SEQ ID NO: 256833 - protein, 14 aa, Artificial Sequence
  Description of Artificial Sequence: Synthetic peptide
  Seed: DPDDSYVFVNTLDL (MAGC1_HUMAN)
  Core: DSYVFVNTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DPDXSYXFXNTXDL

SEQ ID NO: 256834 - protein, 14 aa, Artificial Sequence
  Description of Artificial Sequence: Synthetic peptide
  Seed: DPDDSYVFVNTLDL (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDX

SEQ ID NO: 256835 - protein, 15 aa, Artificial Sequence
  Description of Artificial Sequence: Synthetic peptide
  Seed: DPDDSYVFVNTLDLT (MAGC1_HUMAN)
  Core: DSYVFVNTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DPDXSYXFXNTXDLT

SEQ ID NO: 256836 - protein, 15 aa, Artificial Sequence
  Description of Artificial Sequence: Synthetic peptide
  Seed: DPDDSYVFVNTLDLT (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXT

SEQ ID NO: 256837 - protein, 16 aa, Artificial Sequence
  Description of Artificial Sequence: Synthetic peptide
  Seed: DPDDSYVFVNTLDLTS (MAGC1_HUMAN)
  Core: DSYVFVNTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DPDXSYXFXNTXDLTS

SEQ ID NO: 256838 - protein, 16 aa, Artificial Sequence
  Description of Artificial Sequence: Synthetic peptide
  Seed: DPDDSYVFVNTLDLTS (MAGC1_HUMAN)
  Core: SYVFVNTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DPDDXYVXVXTLXLTS

SEQ ID NO: 256839 - protein, 16 aa, Artificial Sequence
  Description of Artificial Sequence: Synthetic peptide
  Seed: DPDDSYVFVNTLDLTS (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTS

SEQ ID NO: 256840 - protein, 17 aa, Artificial Sequence
  Description of Artificial Sequence: Synthetic peptide
  Seed: DPDDSYVFVNTLDLTSE (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSE

SEQ ID NO: 256841 - protein, 18 aa, Artificial Sequence
  Description of Artificial Sequence: Synthetic peptide
  Seed: DPDDSYVFVNTLDLTSEG (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEG

SEQ ID NO: 256842 - protein, 18 aa, Artificial Sequence
  Description of Artificial Sequence: Synthetic peptide
  Seed: DPDDSYVFVNTLDLTSEG (MAGC1_HUMAN)
  Core: FVNTLDLTS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYVXVNXLXLTXEG

SEQ ID NO: 256843 - protein, 19 aa, Artificial Sequence
  Description of Artificial Sequence: Synthetic peptide
  Seed: DPDDSYVFVNTLDLTSEGC (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGC

SEQ ID NO: 256844 - protein, 19 aa, Artificial Sequence
  Description of Artificial Sequence: Synthetic peptide
  Seed: DPDDSYVFVNTLDLTSEGC (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGC

SEQ ID NO: 256845 - protein, 20 aa, Artificial Sequence
  Description of Artificial Sequence: Synthetic peptide
  Seed: DPDDSYVFVNTLDLTSEGCL (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCL

SEQ ID NO: 256846 - protein, 20 aa, Artificial Sequence
  Description of Artificial Sequence: Synthetic peptide
  Seed: DPDDSYVFVNTLDLTSEGCL (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCL

SEQ ID NO: 256847 - protein, 21 aa, Artificial Sequence
  Description of Artificial Sequence: Synthetic peptide
  Seed: DPDDSYVFVNTLDLTSEGCLS (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCLS

SEQ ID NO: 256848 - protein, 21 aa, Artificial Sequence
  Description of Artificial Sequence: Synthetic peptide
  Seed: DPDDSYVFVNTLDLTSEGCLS (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCLS

SEQ ID NO: 256849 - protein, 22 aa, Artificial Sequence
  Description of Artificial Sequence: Synthetic peptide
  Seed: DPDDSYVFVNTLDLTSEGCLSD (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCLSD

SEQ ID NO: 256850 - protein, 22 aa, Artificial Sequence
  Description of Artificial Sequence: Synthetic peptide
  Seed: DPDDSYVFVNTLDLTSEGCLSD (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCLSD

SEQ ID NO: 256851 - protein, 23 aa, Artificial Sequence
  Description of Artificial Sequence: Synthetic peptide
  Seed: DPDDSYVFVNTLDLTSEGCLSDE (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCLSDE

SEQ ID NO: 256852 - protein, 23 aa, Artificial Sequence
  Description of Artificial Sequence: Synthetic peptide
  Seed: DPDDSYVFVNTLDLTSEGCLSDE (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCLSDE

SEQ ID NO: 256853 - protein, 24 aa, Artificial Sequence
  Description of Artificial Sequence: Synthetic peptide
  Seed: DPDDSYVFVNTLDLTSEGCLSDEQ (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCLSDEQ

SEQ ID NO: 256854 - protein, 24 aa, Artificial Sequence
  Description of Artificial Sequence: Synthetic peptide
  Seed: DPDDSYVFVNTLDLTSEGCLSDEQ (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCLSDEQ

SEQ ID NO: 256855 - protein, 25 aa, Artificial Sequence
  Description of Artificial Sequence: Synthetic peptide
  Seed: DPDDSYVFVNTLDLTSEGCLSDEQG (MAGC1_HUMAN)
  Core: YVFVNTLDL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSXVFXNXLDXTSEGCLSDEQG

SEQ ID NO: 256856 - protein, 25 aa, Artificial Sequence
  Description of Artificial Sequence: Synthetic peptide
  Seed: DPDDSYVFVNTLDLTSEGCLSDEQG (MAGC1_HUMAN)
  Core: VFVNTLDLT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DPDDSYXFVXTXDLXSEGCLSDEQG

SEQ ID NO: 256857 - protein, 14 aa, Artificial Sequence
  Description of Artificial Sequence: Synthetic peptide
  Seed: DSESLIESEPLFTY (MAGC1_HUMAN)
  Core: ESLIESEPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSLXEXEPXFTY

SEQ ID NO: 256858 - protein, 14 aa, Artificial Sequence
  Description of Artificial Sequence: Synthetic peptide
  Seed: DSESLIESEPLFTY (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXY

SEQ ID NO: 256859 - protein, 14 aa, Artificial Sequence
  Description of Artificial Sequence: Synthetic peptide
  Seed: DSESLIESEPLFTY (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTX

SEQ ID NO: 256860 - protein, 15 aa, Artificial Sequence
  Description of Artificial Sequence: Synthetic peptide
  Seed: DSESLIESEPLFTYT (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXYT

SEQ ID NO: 256861 - protein, 15 aa, Artificial Sequence
  Description of Artificial Sequence: Synthetic peptide
  Seed: DSESLIESEPLFTYT (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXT

SEQ ID NO: 256862 - protein, 16 aa, Artificial Sequence
  Description of Artificial Sequence: Synthetic peptide
  Seed: DSESLIESEPLFTYTL (MAGC1_HUMAN)
  Core: ESLIESEPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSLXEXEPXFTYTL

SEQ ID NO: 256863 - protein, 16 aa, Artificial Sequence
  Description of Artificial Sequence: Synthetic peptide
  Seed: DSESLIESEPLFTYTL (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXYTL

SEQ ID NO: 256864 - protein, 16 aa, Artificial Sequence
  Description of Artificial Sequence: Synthetic peptide
  Seed: DSESLIESEPLFTYTL (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTL

SEQ ID NO: 256865 - protein, 17 aa, Artificial Sequence
  Description of Artificial Sequence: Synthetic peptide
  Seed: DSESLIESEPLFTYTLD (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXYTLD

SEQ ID NO: 256866 - protein, 17 aa, Artificial Sequence
  Description of Artificial Sequence: Synthetic peptide
  Seed: DSESLIESEPLFTYTLD (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLD

SEQ ID NO: 256867 - protein, 18 aa, Artificial Sequence
  Description of Artificial Sequence: Synthetic peptide
  Seed: DSESLIESEPLFTYTLDE (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDE

SEQ ID NO: 256868 - protein, 19 aa, Artificial Sequence
  Description of Artificial Sequence: Synthetic peptide
  Seed: DSESLIESEPLFTYTLDEK (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXYTLDEK

SEQ ID NO: 256869 - protein, 19 aa, Artificial Sequence
  Description of Artificial Sequence: Synthetic peptide
  Seed: DSESLIESEPLFTYTLDEK (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEK

SEQ ID NO: 256870 - protein, 19 aa, Artificial Sequence
  Description of Artificial Sequence: Synthetic peptide
  Seed: DSESLIESEPLFTYTLDEK (MAGC1_HUMAN)
  Core: SEPLFTYTL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIEXEPXFXYTXDEK

SEQ ID NO: 256871 - protein, 20 aa, Artificial Sequence
  Description of Artificial Sequence: Synthetic peptide
  Seed: DSESLIESEPLFTYTLDEKV (MAGC1_HUMAN)
  Core: LIESEPLFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSESXIEXEXLFXYTLDEKV

SEQ ID NO: 256872 - protein, 20 aa, Artificial Sequence
  Description of Artificial Sequence: Synthetic peptide
  Seed: DSESLIESEPLFTYTLDEKV (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKV

SEQ ID NO: 256873 - protein, 20 aa, Artificial Sequence
  Description of Artificial Sequence: Synthetic peptide
  Seed: DSESLIESEPLFTYTLDEKV (MAGC1_HUMAN)
  Core: LFTYTLDEK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPXFTXTXDEXV

SEQ ID NO: 256874 - protein, 20 aa, Artificial Sequence
  Description of Artificial Sequence: Synthetic peptide
  Seed: DSESLIESEPLFTYTLDEKV (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKX

SEQ ID NO: 256875 - protein, 21 aa, Artificial Sequence
  Description of Artificial Sequence: Synthetic peptide
  Seed: DSESLIESEPLFTYTLDEKVD (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKVD

SEQ ID NO: 256876 - protein, 21 aa, Artificial Sequence
  Description of Artificial Sequence: Synthetic peptide
  Seed: DSESLIESEPLFTYTLDEKVD (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKXD

SEQ ID NO: 256877 - protein, 22 aa, Artificial Sequence
  Description of Artificial Sequence: Synthetic peptide
  Seed: DSESLIESEPLFTYTLDEKVDE (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKVDE

SEQ ID NO: 256878 - protein, 22 aa, Artificial Sequence
  Description of Artificial Sequence: Synthetic peptide
  Seed: DSESLIESEPLFTYTLDEKVDE (MAGC1_HUMAN)
  Core: LFTYTLDEK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPXFTXTXDEXVDE

SEQ ID NO: 256879 - protein, 22 aa, Artificial Sequence
  Description of Artificial Sequence: Synthetic peptide
  Seed: DSESLIESEPLFTYTLDEKVDE (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKXDE

SEQ ID NO: 256880 - protein, 23 aa, Artificial Sequence
  Description of Artificial Sequence: Synthetic peptide
  Seed: DSESLIESEPLFTYTLDEKVDEL (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKVDEL

SEQ ID NO: 256881 - protein, 23 aa, Artificial Sequence
  Description of Artificial Sequence: Synthetic peptide
  Seed: DSESLIESEPLFTYTLDEKVDEL (MAGC1_HUMAN)
  Core: LFTYTLDEK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPXFTXTXDEXVDEL

SEQ ID NO: 256882 - protein, 23 aa, Artificial Sequence
  Description of Artificial Sequence: Synthetic peptide
  Seed: DSESLIESEPLFTYTLDEKVDEL (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKXDEL

SEQ ID NO: 256883 - protein, 24 aa, Artificial Sequence
  Description of Artificial Sequence: Synthetic peptide
  Seed: DSESLIESEPLFTYTLDEKVDELA (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKVDELA

SEQ ID NO: 256884 - protein, 24 aa, Artificial Sequence
  Description of Artificial Sequence: Synthetic peptide
  Seed: DSESLIESEPLFTYTLDEKVDELA (MAGC1_HUMAN)
  Core: LFTYTLDEK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPXFTXTXDEXVDELA

SEQ ID NO: 256885 - protein, 24 aa, Artificial Sequence
  Description of Artificial Sequence: Synthetic peptide
  Seed: DSESLIESEPLFTYTLDEKVDELA (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKXDELA

SEQ ID NO: 256886 - protein, 24 aa, Artificial Sequence
  Description of Artificial Sequence: Synthetic peptide
  Seed: DSESLIESEPLFTYTLDEKVDELA (MAGC1_HUMAN)
  Core: YTLDEKVDE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLFTXTLXEXVDXLA

SEQ ID NO: 256887 - protein, 25 aa, Artificial Sequence
  Description of Artificial Sequence: Synthetic peptide
  Seed: DSESLIESEPLFTYTLDEKVDELAR (MAGC1_HUMAN)
  Core: IESEPLFTY
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSESLXESXPXFTXTLDEKVDELAR

SEQ ID NO: 256888 - protein, 25 aa, Artificial Sequence
  Description of Artificial Sequence: Synthetic peptide
  Seed: DSESLIESEPLFTYTLDEKVDELAR (MAGC1_HUMAN)
  Core: LFTYTLDEK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPXFTXTXDEXVDELAR

SEQ ID NO: 256889 - protein, 25 aa, Artificial Sequence
  Description of Artificial Sequence: Synthetic peptide
  Seed: DSESLIESEPLFTYTLDEKVDELAR (MAGC1_HUMAN)
  Core: FTYTLDEKV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLXTYXLXEKXDELAR

SEQ ID NO: 256890 - protein, 25 aa, Artificial Sequence
  Description of Artificial Sequence: Synthetic peptide
  Seed: DSESLIESEPLFTYTLDEKVDELAR (MAGC1_HUMAN)
  Core: YTLDEKVDE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
DSESLIESEPLFTXTLXEXVDXLAR

SEQ ID NO: 256891 - protein, 15 aa, Artificial Sequence
  Description of Artificial Sequence: Synthetic peptide
  Seed: DSLSPLHFPQFPPQG (MAGC1_HUMAN)
  Core: LSPLHFPQF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSPXHXPQXPPQG

SEQ ID NO: 256892 - protein, 16 aa, Artificial Sequence
  Description of Artificial Sequence: Synthetic peptide
  Seed: DSLSPLHFPQFPPQGE (MAGC1_HUMAN)
  Core: LSPLHFPQF
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSPXHXPQXPPQGE

SEQ ID NO: 256893 - protein, 20 aa, Artificial Sequence
  Description of Artificial Sequence: Synthetic peptide
  Seed: DSLSPLHFPQFPPQGEDFQS (MAGC1_HUMAN)
  Core: LHFPQFPPQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSLSPXHFXQXPPXGEDFQS

SEQ ID NO: 256894 - protein, 15 aa, Artificial Sequence
  Description of Artificial Sequence: Synthetic peptide
  Seed: DSLSPLQIPQSPLEG (MAGC1_HUMAN)
  Core: LSPLQIPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSPXQXPQXPLEG

SEQ ID NO: 256895 - protein, 20 aa, Artificial Sequence
  Description of Artificial Sequence: Synthetic peptide
  Seed: DSLSPLQIPQSPLEGEDSLS (MAGC1_HUMAN)
  Core: LSPLQIPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSPXQXPQXPLEGEDSLS

SEQ ID NO: 256896 - protein, 25 aa, Artificial Sequence
  Description of Artificial Sequence: Synthetic peptide
  Seed: DSLSPLQIPQSPLEGEDSLSSLHFP (MAGC1_HUMAN)
  Core: LEGEDSLSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSLSPLQIPQSPXEGXDXLSXLHFP

SEQ ID NO: 256897 - protein, 15 aa, Artificial Sequence
  Description of Artificial Sequence: Synthetic peptide
  Seed: DSLSSLHFPQSPPEW (MAGC1_HUMAN)
  Core: LSSLHFPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSSXHXPQXPPEW

SEQ ID NO: 256898 - protein, 16 aa, Artificial Sequence
  Description of Artificial Sequence: Synthetic peptide
  Seed: DSLSSLHFPQSPPEWE (MAGC1_HUMAN)
  Core: LSSLHFPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSSXHXPQXPPEWE

SEQ ID NO: 256899 - protein, 17 aa, Artificial Sequence
  Description of Artificial Sequence: Synthetic peptide
  Seed: DSLSSLHFPQSPPEWED (MAGC1_HUMAN)
  Core: LSSLHFPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSSXHXPQXPPEWED

SEQ ID NO: 256900 - protein, 20 aa, Artificial Sequence
  Description of Artificial Sequence: Synthetic peptide
  Seed: DSLSSLHFPQSPPEWEDSLS (MAGC1_HUMAN)
  Core: LSSLHFPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSSXHXPQXPPEWEDSLS

SEQ ID NO: 256901 - protein, 15 aa, Artificial Sequence
  Description of Artificial Sequence: Synthetic peptide
  Seed: DSLTDSESLIESEPL (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPX

SEQ ID NO: 256902 - protein, 16 aa, Artificial Sequence
  Description of Artificial Sequence: Synthetic peptide
  Seed: DSLTDSESLIESEPLF (MAGC1_HUMAN)
  Core: LTDSESLIE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXTDXEXLIXSEPLF

SEQ ID NO: 256903 - protein, 16 aa, Artificial Sequence
  Description of Artificial Sequence: Synthetic peptide
  Seed: DSLTDSESLIESEPLF (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXF

SEQ ID NO: 256904 - protein, 17 aa, Artificial Sequence
  Description of Artificial Sequence: Synthetic peptide
  Seed: DSLTDSESLIESEPLFT (MAGC1_HUMAN)
  Core: LTDSESLIE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXTDXEXLIXSEPLFT

SEQ ID NO: 256905 - protein, 18 aa, Artificial Sequence
  Description of Artificial Sequence: Synthetic peptide
  Seed: DSLTDSESLIESEPLFTY (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXFTY

SEQ ID NO: 256906 - protein, 18 aa, Artificial Sequence
  Description of Artificial Sequence: Synthetic peptide
  Seed: DSLTDSESLIESEPLFTY (MAGC1_HUMAN)
  Core: LIESEPLFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESXIEXEXLFXY

SEQ ID NO: 256907 - protein, 18 aa, Artificial Sequence
  Description of Artificial Sequence: Synthetic peptide
  Seed: DSLTDSESLIESEPLFTY (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTX

SEQ ID NO: 256908 - protein, 19 aa, Artificial Sequence
  Description of Artificial Sequence: Synthetic peptide
  Seed: DSLTDSESLIESEPLFTYT (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXFTYT

SEQ ID NO: 256909 - protein, 19 aa, Artificial Sequence
  Description of Artificial Sequence: Synthetic peptide
  Seed: DSLTDSESLIESEPLFTYT (MAGC1_HUMAN)
  Core: LIESEPLFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESXIEXEXLFXYT

SEQ ID NO: 256910 - protein, 19 aa, Artificial Sequence
  Description of Artificial Sequence: Synthetic peptide
  Seed: DSLTDSESLIESEPLFTYT (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXT

SEQ ID NO: 256911 - protein, 20 aa, Artificial Sequence
  Description of Artificial Sequence: Synthetic peptide
  Seed: DSLTDSESLIESEPLFTYTL (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXFTYTL

SEQ ID NO: 256912 - protein, 20 aa, Artificial Sequence
  Description of Artificial Sequence: Synthetic peptide
  Seed: DSLTDSESLIESEPLFTYTL (MAGC1_HUMAN)
  Core: LIESEPLFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESXIEXEXLFXYTL

SEQ ID NO: 256913 - protein, 20 aa, Artificial Sequence
  Description of Artificial Sequence: Synthetic peptide
  Seed: DSLTDSESLIESEPLFTYTL (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTL

SEQ ID NO: 256914 - protein, 21 aa, Artificial Sequence
  Description of Artificial Sequence: Synthetic peptide
  Seed: DSLTDSESLIESEPLFTYTLD (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTLD

SEQ ID NO: 256915 - protein, 22 aa, Artificial Sequence
  Description of Artificial Sequence: Synthetic peptide
  Seed: DSLTDSESLIESEPLFTYTLDE (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTLDE

SEQ ID NO: 256916 - protein, 23 aa, Artificial Sequence
  Description of Artificial Sequence: Synthetic peptide
  Seed: DSLTDSESLIESEPLFTYTLDEK (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXFTYTLDEK

SEQ ID NO: 256917 - protein, 23 aa, Artificial Sequence
  Description of Artificial Sequence: Synthetic peptide
  Seed: DSLTDSESLIESEPLFTYTLDEK (MAGC1_HUMAN)
  Core: LIESEPLFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESXIEXEXLFXYTLDEK

SEQ ID NO: 256918 - protein, 23 aa, Artificial Sequence
  Description of Artificial Sequence: Synthetic peptide
  Seed: DSLTDSESLIESEPLFTYTLDEK (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTLDEK

SEQ ID NO: 256919 - protein, 24 aa, Artificial Sequence
  Description of Artificial Sequence: Synthetic peptide
  Seed: DSLTDSESLIESEPLFTYTLDEKV (MAGC1_HUMAN)
  Core: ESLIESEPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSXSLXEXEPXFTYTLDEKV

SEQ ID NO: 256920 - protein, 24 aa, Artificial Sequence
  Description of Artificial Sequence: Synthetic peptide
  Seed: DSLTDSESLIESEPLFTYTLDEKV (MAGC1_HUMAN)
  Core: LIESEPLFT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESXIEXEXLFXYTLDEKV

SEQ ID NO: 256921 - protein, 24 aa, Artificial Sequence
  Description of Artificial Sequence: Synthetic peptide
  Seed: DSLTDSESLIESEPLFTYTLDEKV (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTLDEKV

SEQ ID NO: 256922 - protein, 24 aa, Artificial Sequence
  Description of Artificial Sequence: Synthetic peptide
  Seed: DSLTDSESLIESEPLFTYTLDEKV (MAGC1_HUMAN)
  Core: FTYTLDEKV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLIESEPLXTYXLXEKX

SEQ ID NO: 256923 - protein, 25 aa, Artificial Sequence
  Description of Artificial Sequence: Synthetic peptide
  Seed: DSLTDSESLIESEPLFTYTLDEKVD (MAGC1_HUMAN)
  Core: IESEPLFTY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLXESXPXFTXTLDEKVD

SEQ ID NO: 256924 - protein, 25 aa, Artificial Sequence
  Description of Artificial Sequence: Synthetic peptide
  Seed: DSLTDSESLIESEPLFTYTLDEKVD (MAGC1_HUMAN)
  Core: LFTYTLDEK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLIESEPXFTXTXDEXVD

SEQ ID NO: 256925 - protein, 25 aa, Artificial Sequence
  Description of Artificial Sequence: Synthetic peptide
  Seed: DSLTDSESLIESEPLFTYTLDEKVD (MAGC1_HUMAN)
  Core: FTYTLDEKV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DSLTDSESLIESEPLXTYXLXEKXD

SEQ ID NO: 256926 - protein, 15 aa, Artificial Sequence
  Description of Artificial Sequence: Synthetic peptide
  Seed: DSMSPLYFPQSPLQG (MAGC1_HUMAN)
  Core: MSPLYFPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXSPXYXPQXPLQG

SEQ ID NO: 256927 - protein, 15 aa, Artificial Sequence
  Description of Artificial Sequence: Synthetic peptide
  Seed: DSMSPLYFPQSPLQG (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQX

SEQ ID NO: 256928 - protein, 16 aa, Artificial Sequence
  Description of Artificial Sequence: Synthetic peptide
  Seed: DSMSPLYFPQSPLQGE (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXE

SEQ ID NO: 256929 - protein, 17 aa, Artificial Sequence
  Description of Artificial Sequence: Synthetic peptide
  Seed: DSMSPLYFPQSPLQGEE (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEE

SEQ ID NO: 256930 - protein, 18 aa, Artificial Sequence
  Description of Artificial Sequence: Synthetic peptide
  Seed: DSMSPLYFPQSPLQGEEF (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEF

SEQ ID NO: 256931 - protein, 19 aa, Artificial Sequence
  Description of Artificial Sequence: Synthetic peptide
  Seed: DSMSPLYFPQSPLQGEEFQ (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQ

SEQ ID NO: 256932 - protein, 20 aa, Artificial Sequence
  Description of Artificial Sequence: Synthetic peptide
  Seed: DSMSPLYFPQSPLQGEEFQS (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQS

SEQ ID NO: 256933 - protein, 21 aa, Artificial Sequence
  Description of Artificial Sequence: Synthetic peptide
  Seed: DSMSPLYFPQSPLQGEEFQSS (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQSS

SEQ ID NO: 256934 - protein, 21 aa, Artificial Sequence
  Description of Artificial Sequence: Synthetic peptide
  Seed: DSMSPLYFPQSPLQGEEFQSS (MAGC1_HUMAN)
  Core: LQGEEFQSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLYFPQSPXQGXEXQSX

SEQ ID NO: 256935 - protein, 22 aa, Artificial Sequence
  Description of Artificial Sequence: Synthetic peptide
  Seed: DSMSPLYFPQSPLQGEEFQSSL (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQSSL

SEQ ID NO: 256936 - protein, 22 aa, Artificial Sequence
  Description of Artificial Sequence: Synthetic peptide
  Seed: DSMSPLYFPQSPLQGEEFQSSL (MAGC1_HUMAN)
  Core: LQGEEFQSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLYFPQSPXQGXEXQSXL

SEQ ID NO: 256937 - protein, 23 aa, Artificial Sequence
  Description of Artificial Sequence: Synthetic peptide
  Seed: DSMSPLYFPQSPLQGEEFQSSLQ (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQSSLQ

SEQ ID NO: 256938 - protein, 23 aa, Artificial Sequence
  Description of Artificial Sequence: Synthetic peptide
  Seed: DSMSPLYFPQSPLQGEEFQSSLQ (MAGC1_HUMAN)
  Core: LQGEEFQSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLYFPQSPXQGXEXQSXLQ

SEQ ID NO: 256939 - protein, 24 aa, Artificial Sequence
  Description of Artificial Sequence: Synthetic peptide
  Seed: DSMSPLYFPQSPLQGEEFQSSLQS (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQSSLQS

SEQ ID NO: 256940 - protein, 24 aa, Artificial Sequence
  Description of Artificial Sequence: Synthetic peptide
  Seed: DSMSPLYFPQSPLQGEEFQSSLQS (MAGC1_HUMAN)
  Core: LQGEEFQSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLYFPQSPXQGXEXQSXLQS

SEQ ID NO: 256941 - protein, 25 aa, Artificial Sequence
  Description of Artificial Sequence: Synthetic peptide
  Seed: DSMSPLYFPQSPLQGEEFQSSLQSP (MAGC1_HUMAN)
  Core: YFPQSPLQG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLXFPXSXLQXEEFQSSLQSP

SEQ ID NO: 256942 - protein, 25 aa, Artificial Sequence
  Description of Artificial Sequence: Synthetic peptide
  Seed: DSMSPLYFPQSPLQGEEFQSSLQSP (MAGC1_HUMAN)
  Core: LQGEEFQSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DSMSPLYFPQSPXQGXEXQSXLQSP

SEQ ID NO: 256943 - protein, 14 aa, Artificial Sequence
  Description of Artificial Sequence: Synthetic peptide
  Seed: DSTATESASSSVMS (MAGC1_HUMAN)
  Core: TATESASSS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXATXSXSSXVMS

SEQ ID NO: 256944 - protein, 14 aa, Artificial Sequence
  Description of Artificial Sequence: Synthetic peptide
  Seed: DSTATESASSSVMS (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXS

SEQ ID NO: 256945 - protein, 15 aa, Artificial Sequence
  Description of Artificial Sequence: Synthetic peptide
  Seed: DSTATESASSSVMSP (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXSP

SEQ ID NO: 256946 - protein, 15 aa, Artificial Sequence
  Description of Artificial Sequence: Synthetic peptide
  Seed: DSTATESASSSVMSP (MAGC1_HUMAN)
  Core: ESASSSVMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSTATXSAXSXVMXP

SEQ ID NO: 256947 - protein, 16 aa, Artificial Sequence
  Description of Artificial Sequence: Synthetic peptide
  Seed: DSTATESASSSVMSPS (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXSPS

SEQ ID NO: 256948 - protein, 16 aa, Artificial Sequence
  Description of Artificial Sequence: Synthetic peptide
  Seed: DSTATESASSSVMSPS (MAGC1_HUMAN)
  Core: ESASSSVMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSTATXSAXSXVMXPS

SEQ ID NO: 256949 - protein, 17 aa, Artificial Sequence
  Description of Artificial Sequence: Synthetic peptide
  Seed: DSTATESASSSVMSPSF (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXSPSF

SEQ ID NO: 256950 - protein, 17 aa, Artificial Sequence
  Description of Artificial Sequence: Synthetic peptide
  Seed: DSTATESASSSVMSPSF (MAGC1_HUMAN)
  Core: ESASSSVMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSTATXSAXSXVMXPSF

SEQ ID NO: 256951 - protein, 17 aa, Artificial Sequence
  Description of Artificial Sequence: Synthetic peptide
  Seed: DSTATESASSSVMSPSF (MAGC1_HUMAN)
  Core: ASSSVMSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSTATESXSSXVXSPXF

SEQ ID NO: 256952 - protein, 18 aa, Artificial Sequence
  Description of Artificial Sequence: Synthetic peptide
  Seed: DSTATESASSSVMSPSFS (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXSPSFS

SEQ ID NO: 256953 - protein, 18 aa, Artificial Sequence
  Description of Artificial Sequence: Synthetic peptide
  Seed: DSTATESASSSVMSPSFS (MAGC1_HUMAN)
  Core: ESASSSVMS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSTATXSAXSXVMXPSFS

SEQ ID NO: 256954 - protein, 18 aa, Artificial Sequence
  Description of Artificial Sequence: Synthetic peptide
  Seed: DSTATESASSSVMSPSFS (MAGC1_HUMAN)
  Core: ASSSVMSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSTATESXSSXVXSPXFS

SEQ ID NO: 256955 - protein, 19 aa, Artificial Sequence
  Description of Artificial Sequence: Synthetic peptide
  Seed: DSTATESASSSVMSPSFSS (MAGC1_HUMAN)
  Core: TESASSSVM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSTAXESXSXSVXSPSFSS

SEQ ID NO: 256956 - protein, 19 aa, Artificial Sequence
  Description of Artificial Sequence: Synthetic peptide
  Seed: DSTATESASSSVMSPSFSS (MAGC1_HUMAN)
  Core: ASSSVMSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSTATESXSSXVXSPXFSS

SEQ ID NO: 256957 - protein, 20 aa, Artificial Sequence
  Description of Artificial Sequence: Synthetic peptide
  Seed: DSTATESASSSVMSPSFSSE (MAGC1_HUMAN)
  Core: ASSSVMSPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DSTATESXSSXVXSPXFSSE

SEQ ID NO: 256958 - protein, 13 aa, Artificial Sequence
  Description of Artificial Sequence: Synthetic peptide
  Seed: DSYVFVNTLDLTS (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTS

SEQ ID NO: 256959 - protein, 13 aa, Artificial Sequence
  Description of Artificial Sequence: Synthetic peptide
  Seed: DSYVFVNTLDLTS (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXS

SEQ ID NO: 256960 - protein, 14 aa, Artificial Sequence
  Description of Artificial Sequence: Synthetic peptide
  Seed: DSYVFVNTLDLTSE (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSE

SEQ ID NO: 256961 - protein, 14 aa, Artificial Sequence
  Description of Artificial Sequence: Synthetic peptide
  Seed: DSYVFVNTLDLTSE (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSE

SEQ ID NO: 256962 - protein, 14 aa, Artificial Sequence
  Description of Artificial Sequence: Synthetic peptide
  Seed: DSYVFVNTLDLTSE (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXE

SEQ ID NO: 256963 - protein, 15 aa, Artificial Sequence
  Description of Artificial Sequence: Synthetic peptide
  Seed: DSYVFVNTLDLTSEG (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEG

SEQ ID NO: 256964 - protein, 15 aa, Artificial Sequence
  Description of Artificial Sequence: Synthetic peptide
  Seed: DSYVFVNTLDLTSEG (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEG

SEQ ID NO: 256965 - protein, 15 aa, Artificial Sequence
  Description of Artificial Sequence: Synthetic peptide
  Seed: DSYVFVNTLDLTSEG (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEG

SEQ ID NO: 256966 - protein, 15 aa, Artificial Sequence
  Description of Artificial Sequence: Synthetic peptide
  Seed: DSYVFVNTLDLTSEG (MAGC1_HUMAN)
  Core: VNTLDLTSE
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFXNTXDXTSXG

SEQ ID NO: 256967 - protein, 16 aa, Artificial Sequence
  Description of Artificial Sequence: Synthetic peptide
  Seed: DSYVFVNTLDLTSEGC (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGC

SEQ ID NO: 256968 - protein, 16 aa, Artificial Sequence
  Description of Artificial Sequence: Synthetic peptide
  Seed: DSYVFVNTLDLTSEGC (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGC

SEQ ID NO: 256969 - protein, 16 aa, Artificial Sequence
  Description of Artificial Sequence: Synthetic peptide
  Seed: DSYVFVNTLDLTSEGC (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGC

SEQ ID NO: 256970 - protein, 17 aa, Artificial Sequence
  Description of Artificial Sequence: Synthetic peptide
  Seed: DSYVFVNTLDLTSEGCL (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCL

SEQ ID NO: 256971 - protein, 17 aa, Artificial Sequence
  Description of Artificial Sequence: Synthetic peptide
  Seed: DSYVFVNTLDLTSEGCL (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCL

SEQ ID NO: 256972 - protein, 17 aa, Artificial Sequence
  Description of Artificial Sequence: Synthetic peptide
  Seed: DSYVFVNTLDLTSEGCL (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCL

SEQ ID NO: 256973 - protein, 18 aa, Artificial Sequence
  Description of Artificial Sequence: Synthetic peptide
  Seed: DSYVFVNTLDLTSEGCLS (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLS

SEQ ID NO: 256974 - protein, 18 aa, Artificial Sequence
  Description of Artificial Sequence: Synthetic peptide
  Seed: DSYVFVNTLDLTSEGCLS (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLS

SEQ ID NO: 256975 - protein, 18 aa, Artificial Sequence
  Description of Artificial Sequence: Synthetic peptide
  Seed: DSYVFVNTLDLTSEGCLS (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLS

SEQ ID NO: 256976 - protein, 19 aa, Artificial Sequence
  Description of Artificial Sequence: Synthetic peptide
  Seed: DSYVFVNTLDLTSEGCLSD (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSD

SEQ ID NO: 256977 - protein, 19 aa, Artificial Sequence
  Description of Artificial Sequence: Synthetic peptide
  Seed: DSYVFVNTLDLTSEGCLSD (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSD

SEQ ID NO: 256978 - protein, 19 aa, Artificial Sequence
  Description of Artificial Sequence: Synthetic peptide
  Seed: DSYVFVNTLDLTSEGCLSD (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSD

SEQ ID NO: 256979 - protein, 20 aa, Artificial Sequence
  Description of Artificial Sequence: Synthetic peptide
  Seed: DSYVFVNTLDLTSEGCLSDE (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDE

SEQ ID NO: 256980 - protein, 20 aa, Artificial Sequence
  Description of Artificial Sequence: Synthetic peptide
  Seed: DSYVFVNTLDLTSEGCLSDE (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDE

SEQ ID NO: 256981 - protein, 20 aa, Artificial Sequence
  Description of Artificial Sequence: Synthetic peptide
  Seed: DSYVFVNTLDLTSEGCLSDE (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDE

SEQ ID NO: 256982 - protein, 21 aa, Artificial Sequence
  Description of Artificial Sequence: Synthetic peptide
  Seed: DSYVFVNTLDLTSEGCLSDEQ (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDEQ

SEQ ID NO: 256983 - protein, 21 aa, Artificial Sequence
  Description of Artificial Sequence: Synthetic peptide
  Seed: DSYVFVNTLDLTSEGCLSDEQ (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDEQ

SEQ ID NO: 256984 - protein, 21 aa, Artificial Sequence
  Description of Artificial Sequence: Synthetic peptide
  Seed: DSYVFVNTLDLTSEGCLSDEQ (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDEQ

SEQ ID NO: 256985 - protein, 21 aa, Artificial Sequence
  Description of Artificial Sequence: Synthetic peptide
  Seed: DSYVFVNTLDLTSEGCLSDEQ (MAGC1_HUMAN)
  Core: LTSEGCLSD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFVNTLDXTSXGXLSXEQ

SEQ ID NO: 256986 - protein, 22 aa, Artificial Sequence
  Description of Artificial Sequence: Synthetic peptide
  Seed: DSYVFVNTLDLTSEGCLSDEQG (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDEQG

SEQ ID NO: 256987 - protein, 22 aa, Artificial Sequence
  Description of Artificial Sequence: Synthetic peptide
  Seed: DSYVFVNTLDLTSEGCLSDEQG (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDEQG

SEQ ID NO: 256988 - protein, 22 aa, Artificial Sequence
  Description of Artificial Sequence: Synthetic peptide
  Seed: DSYVFVNTLDLTSEGCLSDEQG (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDEQG

SEQ ID NO: 256989 - protein, 22 aa, Artificial Sequence
  Description of Artificial Sequence: Synthetic peptide
  Seed: DSYVFVNTLDLTSEGCLSDEQG (MAGC1_HUMAN)
  Core: LTSEGCLSD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFVNTLDXTSXGXLSXEQG

SEQ ID NO: 256990 - protein, 23 aa, Artificial Sequence
  Description of Artificial Sequence: Synthetic peptide
  Seed: DSYVFVNTLDLTSEGCLSDEQGM (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDEQGM

SEQ ID NO: 256991 - protein, 23 aa, Artificial Sequence
  Description of Artificial Sequence: Synthetic peptide
  Seed: DSYVFVNTLDLTSEGCLSDEQGM (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDEQGM

SEQ ID NO: 256992 - protein, 23 aa, Artificial Sequence
  Description of Artificial Sequence: Synthetic peptide
  Seed: DSYVFVNTLDLTSEGCLSDEQGM (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDEQGM

SEQ ID NO: 256993 - protein, 23 aa, Artificial Sequence
  Description of Artificial Sequence: Synthetic peptide
  Seed: DSYVFVNTLDLTSEGCLSDEQGM (MAGC1_HUMAN)
  Core: LTSEGCLSD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFVNTLDXTSXGXLSXEQGM

SEQ ID NO: 256994 - protein, 24 aa, Artificial Sequence
  Description of Artificial Sequence: Synthetic peptide
  Seed: DSYVFVNTLDLTSEGCLSDEQGMS (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDEQGMS

SEQ ID NO: 256995 - protein, 24 aa, Artificial Sequence
  Description of Artificial Sequence: Synthetic peptide
  Seed: DSYVFVNTLDLTSEGCLSDEQGMS (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDEQGMS

SEQ ID NO: 256996 - protein, 24 aa, Artificial Sequence
  Description of Artificial Sequence: Synthetic peptide
  Seed: DSYVFVNTLDLTSEGCLSDEQGMS (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDEQGMS

SEQ ID NO: 256997 - protein, 24 aa, Artificial Sequence
  Description of Artificial Sequence: Synthetic peptide
  Seed: DSYVFVNTLDLTSEGCLSDEQGMS (MAGC1_HUMAN)
  Core: LTSEGCLSD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFVNTLDXTSXGXLSXEQGMS

SEQ ID NO: 256998 - protein, 25 aa, Artificial Sequence
  Description of Artificial Sequence: Synthetic peptide
  Seed: DSYVFVNTLDLTSEGCLSDEQGMSQ (MAGC1_HUMAN)
  Core: YVFVNTLDL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DSXVFXNXLDXTSEGCLSDEQGMSQ

SEQ ID NO: 256999 - protein, 25 aa, Artificial Sequence
  Description of Artificial Sequence: Synthetic peptide
  Seed: DSYVFVNTLDLTSEGCLSDEQGMSQ (MAGC1_HUMAN)
  Core: VFVNTLDLT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
DSYXFVXTXDLXSEGCLSDEQGMSQ

SEQ ID NO: 257000 - protein, 25 aa, Artificial Sequence
  Description of Artificial Sequence: Synthetic peptide
  Seed: DSYVFVNTLDLTSEGCLSDEQGMSQ (MAGC1_HUMAN)
  Core: FVNTLDLTS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DSYVXVNXLXLTXEGCLSDEQGMSQ

SEQ ID NO: 257001 - protein, 25 aa, Artificial Sequence
  Description of Artificial Sequence: Synthetic peptide
  Seed: DSYVFVNTLDLTSEGCLSDEQGMSQ (MAGC1_HUMAN)
  Core: LTSEGCLSD
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DSYVFVNTLDXTSXGXLSXEQGMSQ

SEQ ID NO: 257002 - protein, 23 aa, Artificial Sequence
  Description of Artificial Sequence: Synthetic peptide
  Seed: DTLLESDSLTDSESLIESEPLFT (MAGC1_HUMAN)
  Core: LTDSESLIE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSXTDXEXLIXSEPLFT

SEQ ID NO: 257003 - protein, 24 aa, Artificial Sequence
  Description of Artificial Sequence: Synthetic peptide
  Seed: DTLLESDSLTDSESLIESEPLFTY (MAGC1_HUMAN)
  Core: SLTDSESLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDXLTXSXSLXESEPLFTY

SEQ ID NO: 257004 - protein, 24 aa, Artificial Sequence
  Description of Artificial Sequence: Synthetic peptide
  Seed: DTLLESDSLTDSESLIESEPLFTY (MAGC1_HUMAN)
  Core: LTDSESLIE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSXTDXEXLIXSEPLFTY

SEQ ID NO: 257005 - protein, 24 aa, Artificial Sequence
  Description of Artificial Sequence: Synthetic peptide
  Seed: DTLLESDSLTDSESLIESEPLFTY (MAGC1_HUMAN)
  Core: IESEPLFTY
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSLTDSESLXESXPXFTX

SEQ ID NO: 257006 - protein, 25 aa, Artificial Sequence
  Description of Artificial Sequence: Synthetic peptide
  Seed: DTLLESDSLTDSESLIESEPLFTYT (MAGC1_HUMAN)
  Core: SLTDSESLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDXLTXSXSLXESEPLFTYT

SEQ ID NO: 257007 - protein, 25 aa, Artificial Sequence
  Description of Artificial Sequence: Synthetic peptide
  Seed: DTLLESDSLTDSESLIESEPLFTYT (MAGC1_HUMAN)
  Core: LTDSESLIE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSXTDXEXLIXSEPLFTYT

SEQ ID NO: 257008 - protein, 25 aa, Artificial Sequence
  Description of Artificial Sequence: Synthetic peptide
  Seed: DTLLESDSLTDSESLIESEPLFTYT (MAGC1_HUMAN)
  Core: ESLIESEPL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSLTDSXSLXEXEPXFTYT

SEQ ID NO: 257009 - protein, 25 aa, Artificial Sequence
  Description of Artificial Sequence: Synthetic peptide
  Seed: DTLLESDSLTDSESLIESEPLFTYT (MAGC1_HUMAN)
  Core: IESEPLFTY
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
DTLLESDSLTDSESLXESXPXFTXT

SEQ ID NO: 257010 - protein, 13 aa, Artificial Sequence
  Description of Artificial Sequence: Synthetic peptide
  Seed: DTLYPLQSPQSRS (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRS

SEQ ID NO: 257011 - protein, 14 aa, Artificial Sequence
  Description of Artificial Sequence: Synthetic peptide
  Seed: DTLYPLQSPQSRSE (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSE

SEQ ID NO: 257012 - protein, 15 aa, Artificial Sequence
  Description of Artificial Sequence: Synthetic peptide
  Seed: DTLYPLQSPQSRSEG (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEG

SEQ ID NO: 257013 - protein, 16 aa, Artificial Sequence
  Description of Artificial Sequence: Synthetic peptide
  Seed: DTLYPLQSPQSRSEGE (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGE

SEQ ID NO: 257014 - protein, 17 aa, Artificial Sequence
  Description of Artificial Sequence: Synthetic peptide
  Seed: DTLYPLQSPQSRSEGED (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGED

SEQ ID NO: 257015 - protein, 19 aa, Artificial Sequence
  Description of Artificial Sequence: Synthetic peptide
  Seed: DTLYPLQSPQSRSEGEDSS (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSS

SEQ ID NO: 257016 - protein, 20 aa, Artificial Sequence
  Description of Artificial Sequence: Synthetic peptide
  Seed: DTLYPLQSPQSRSEGEDSSD (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSD

SEQ ID NO: 257017 - protein, 21 aa, Artificial Sequence
  Description of Artificial Sequence: Synthetic peptide
  Seed: DTLYPLQSPQSRSEGEDSSDP (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSDP

SEQ ID NO: 257018 - protein, 22 aa, Artificial Sequence
  Description of Artificial Sequence: Synthetic peptide
  Seed: DTLYPLQSPQSRSEGEDSSDPL (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSDPL

SEQ ID NO: 257019 - protein, 23 aa, Artificial Sequence
  Description of Artificial Sequence: Synthetic peptide
  Seed: DTLYPLQSPQSRSEGEDSSDPLQ (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSDPLQ

SEQ ID NO: 257020 - protein, 24 aa, Artificial Sequence
  Description of Artificial Sequence: Synthetic peptide
  Seed: DTLYPLQSPQSRSEGEDSSDPLQR (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSDPLQR

SEQ ID NO: 257021 - protein, 25 aa, Artificial Sequence
  Description of Artificial Sequence: Synthetic peptide
  Seed: DTLYPLQSPQSRSEGEDSSDPLQRP (MAGC1_HUMAN)
  Core: LYPLQSPQS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DTXYPXQXPQXRSEGEDSSDPLQRP

SEQ ID NO: 257022 - protein, 15 aa, Artificial Sequence
  Description of Artificial Sequence: Synthetic peptide
  Seed: DTTDDSTATESASSS (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXS

SEQ ID NO: 257023 - protein, 16 aa, Artificial Sequence
  Description of Artificial Sequence: Synthetic peptide
  Seed: DTTDDSTATESASSSV (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSV

SEQ ID NO: 257024 - protein, 17 aa, Artificial Sequence
  Description of Artificial Sequence: Synthetic peptide
  Seed: DTTDDSTATESASSSVM (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVM

SEQ ID NO: 257025 - protein, 18 aa, Artificial Sequence
  Description of Artificial Sequence: Synthetic peptide
  Seed: DTTDDSTATESASSSVMS (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMS

SEQ ID NO: 257026 - protein, 19 aa, Artificial Sequence
  Description of Artificial Sequence: Synthetic peptide
  Seed: DTTDDSTATESASSSVMSP (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSP

SEQ ID NO: 257027 - protein, 20 aa, Artificial Sequence
  Description of Artificial Sequence: Synthetic peptide
  Seed: DTTDDSTATESASSSVMSPS (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSPS

SEQ ID NO: 257028 - protein, 20 aa, Artificial Sequence
  Description of Artificial Sequence: Synthetic peptide
  Seed: DTTDDSTATESASSSVMSPS (MAGC1_HUMAN)
  Core: TATESASSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSXATXSXSSXVMSPS

SEQ ID NO: 257029 - protein, 20 aa, Artificial Sequence
  Description of Artificial Sequence: Synthetic peptide
  Seed: DTTDDSTATESASSSVMSPS (MAGC1_HUMAN)
  Core: TESASSSVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTAXESXSXSVXSPS

SEQ ID NO: 257030 - protein, 21 aa, Artificial Sequence
  Description of Artificial Sequence: Synthetic peptide
  Seed: DTTDDSTATESASSSVMSPSF (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSPSF

SEQ ID NO: 257031 - protein, 21 aa, Artificial Sequence
  Description of Artificial Sequence: Synthetic peptide
  Seed: DTTDDSTATESASSSVMSPSF (MAGC1_HUMAN)
  Core: TATESASSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSXATXSXSSXVMSPSF

SEQ ID NO: 257032 - protein, 21 aa, Artificial Sequence
  Description of Artificial Sequence: Synthetic peptide
  Seed: DTTDDSTATESASSSVMSPSF (MAGC1_HUMAN)
  Core: TESASSSVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTAXESXSXSVXSPSF

SEQ ID NO: 257033 - protein, 22 aa, Artificial Sequence
  Description of Artificial Sequence: Synthetic peptide
  Seed: DTTDDSTATESASSSVMSPSFS (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSPSFS

SEQ ID NO: 257034 - protein, 22 aa, Artificial Sequence
  Description of Artificial Sequence: Synthetic peptide
  Seed: DTTDDSTATESASSSVMSPSFS (MAGC1_HUMAN)
  Core: TATESASSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSXATXSXSSXVMSPSFS

SEQ ID NO: 257035 - protein, 22 aa, Artificial Sequence
  Description of Artificial Sequence: Synthetic peptide
  Seed: DTTDDSTATESASSSVMSPSFS (MAGC1_HUMAN)
  Core: TESASSSVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTAXESXSXSVXSPSFS

SEQ ID NO: 257036 - protein, 22 aa, Artificial Sequence
  Description of Artificial Sequence: Synthetic peptide
  Seed: DTTDDSTATESASSSVMSPSFS (MAGC1_HUMAN)
  Core: ESASSSVMS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTATXSAXSXVMXPSFS

SEQ ID NO: 257037 - protein, 23 aa, Artificial Sequence
  Description of Artificial Sequence: Synthetic peptide
  Seed: DTTDDSTATESASSSVMSPSFSS (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSPSFSS

SEQ ID NO: 257038 - protein, 23 aa, Artificial Sequence
  Description of Artificial Sequence: Synthetic peptide
  Seed: DTTDDSTATESASSSVMSPSFSS (MAGC1_HUMAN)
  Core: TATESASSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSXATXSXSSXVMSPSFSS

SEQ ID NO: 257039 - protein, 23 aa, Artificial Sequence
  Description of Artificial Sequence: Synthetic peptide
  Seed: DTTDDSTATESASSSVMSPSFSS (MAGC1_HUMAN)
  Core: TESASSSVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTAXESXSXSVXSPSFSS

SEQ ID NO: 257040 - protein, 23 aa, Artificial Sequence
  Description of Artificial Sequence: Synthetic peptide
  Seed: DTTDDSTATESASSSVMSPSFSS (MAGC1_HUMAN)
  Core: ASSSVMSPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTATESXSSXVXSPXFSS

SEQ ID NO: 257041 - protein, 24 aa, Artificial Sequence
  Description of Artificial Sequence: Synthetic peptide
  Seed: DTTDDSTATESASSSVMSPSFSSE (MAGC1_HUMAN)
  Core: STATESASS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDXTAXEXASXSVMSPSFSSE

SEQ ID NO: 257042 - protein, 24 aa, Artificial Sequence
  Description of Artificial Sequence: Synthetic peptide
  Seed: DTTDDSTATESASSSVMSPSFSSE (MAGC1_HUMAN)
  Core: TATESASSS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSXATXSXSSXVMSPSFSSE

SEQ ID NO: 257043 - protein, 24 aa, Artificial Sequence
  Description of Artificial Sequence: Synthetic peptide
  Seed: DTTDDSTATESASSSVMSPSFSSE (MAGC1_HUMAN)
  Core: TESASSSVM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTAXESXSXSVXSPSFSSE

SEQ ID NO: 257044 - protein, 24 aa, Artificial Sequence
  Description of Artificial Sequence: Synthetic peptide
  Seed: DTTDDSTATESASSSVMSPSFSSE (MAGC1_HUMAN)
  Core: ASSSVMSPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DTTDDSTATESXSSXVXSPXFSSE

SEQ ID NO: 257045 - protein, 19 aa, Artificial Sequence
  Description of Artificial Sequence: Synthetic peptide
  Seed: DVEERAQAIIDTTDDSTAT (MAGC1_HUMAN)
  Core: AQAIIDTTD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DVEERXQAXIXTTXDSTAT

SEQ ID NO: 257046 - protein, 20 aa, Artificial Sequence
  Description of Artificial Sequence: Synthetic peptide
  Seed: DVEERAQAIIDTTDDSTATE (MAGC1_HUMAN)
  Core: AQAIIDTTD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DVEERXQAXIXTTXDSTATE

SEQ ID NO: 257047 - protein, 25 aa, Artificial Sequence
  Description of Artificial Sequence: Synthetic peptide
  Seed: DVEERAQAIIDTTDDSTATESASSS (MAGC1_HUMAN)
  Core: AQAIIDTTD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DVEERXQAXIXTTXDSTATESASSS

SEQ ID NO: 257048 - protein, 13 aa, Artificial Sequence
  Description of Artificial Sequence: Synthetic peptide
  Seed: DVLSGIGVRAGRE (MAGC1_HUMAN)
  Core: VLSGIGVRA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXLSXIXVRXGRE

SEQ ID NO: 257049 - protein, 13 aa, Artificial Sequence
  Description of Artificial Sequence: Synthetic peptide
  Seed: DVLSGIGVRAGRE (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXRE

SEQ ID NO: 257050 - protein, 14 aa, Artificial Sequence
  Description of Artificial Sequence: Synthetic peptide
  Seed: DVLSGIGVRAGREH (MAGC1_HUMAN)
  Core: VLSGIGVRA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXLSXIXVRXGREH

SEQ ID NO: 257051 - protein, 14 aa, Artificial Sequence
  Description of Artificial Sequence: Synthetic peptide
  Seed: DVLSGIGVRAGREH (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREH

SEQ ID NO: 257052 - protein, 15 aa, Artificial Sequence
  Description of Artificial Sequence: Synthetic peptide
  Seed: DVLSGIGVRAGREHF (MAGC1_HUMAN)
  Core: VLSGIGVRA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXLSXIXVRXGREHF

SEQ ID NO: 257053 - protein, 15 aa, Artificial Sequence
  Description of Artificial Sequence: Synthetic peptide
  Seed: DVLSGIGVRAGREHF (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHF

SEQ ID NO: 257054 - protein, 16 aa, Artificial Sequence
  Description of Artificial Sequence: Synthetic peptide
  Seed: DVLSGIGVRAGREHFA (MAGC1_HUMAN)
  Core: VLSGIGVRA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXLSXIXVRXGREHFA

SEQ ID NO: 257055 - protein, 16 aa, Artificial Sequence
  Description of Artificial Sequence: Synthetic peptide
  Seed: DVLSGIGVRAGREHFA (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFA

SEQ ID NO: 257056 - protein, 16 aa, Artificial Sequence
  Description of Artificial Sequence: Synthetic peptide
  Seed: DVLSGIGVRAGREHFA (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFX

SEQ ID NO: 257057 - protein, 17 aa, Artificial Sequence
  Description of Artificial Sequence: Synthetic peptide
  Seed: DVLSGIGVRAGREHFAF (MAGC1_HUMAN)
  Core: VLSGIGVRA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
DXLSXIXVRXGREHFAF

SEQ ID NO: 257058 - protein, 17 aa, Artificial Sequence
  Description of Artificial Sequence: Synthetic peptide
  Seed: DVLSGIGVRAGREHFAF (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAF

SEQ ID NO: 257059 - protein, 17 aa, Artificial Sequence
  Description of Artificial Sequence: Synthetic peptide
  Seed: DVLSGIGVRAGREHFAF (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXF

SEQ ID NO: 257060 - protein, 18 aa, Artificial Sequence
  Description of Artificial Sequence: Synthetic peptide
  Seed: DVLSGIGVRAGREHFAFG (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFG

SEQ ID NO: 257061 - protein, 18 aa, Artificial Sequence
  Description of Artificial Sequence: Synthetic peptide
  Seed: DVLSGIGVRAGREHFAFG (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFG

SEQ ID NO: 257062 - protein, 19 aa, Artificial Sequence
  Description of Artificial Sequence: Synthetic peptide
  Seed: DVLSGIGVRAGREHFAFGE (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGE

SEQ ID NO: 257063 - protein, 19 aa, Artificial Sequence
  Description of Artificial Sequence: Synthetic peptide
  Seed: DVLSGIGVRAGREHFAFGE (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGE

SEQ ID NO: 257064 - protein, 20 aa, Artificial Sequence
  Description of Artificial Sequence: Synthetic peptide
  Seed: DVLSGIGVRAGREHFAFGEP (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEP

SEQ ID NO: 257065 - protein, 20 aa, Artificial Sequence
  Description of Artificial Sequence: Synthetic peptide
  Seed: DVLSGIGVRAGREHFAFGEP (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEP

SEQ ID NO: 257066 - protein, 21 aa, Artificial Sequence
  Description of Artificial Sequence: Synthetic peptide
  Seed: DVLSGIGVRAGREHFAFGEPR (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEPR

SEQ ID NO: 257067 - protein, 21 aa, Artificial Sequence
  Description of Artificial Sequence: Synthetic peptide
  Seed: DVLSGIGVRAGREHFAFGEPR (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEPR

SEQ ID NO: 257068 - protein, 22 aa, Artificial Sequence
  Description of Artificial Sequence: Synthetic peptide
  Seed: DVLSGIGVRAGREHFAFGEPRE (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEPRE

SEQ ID NO: 257069 - protein, 22 aa, Artificial Sequence
  Description of Artificial Sequence: Synthetic peptide
  Seed: DVLSGIGVRAGREHFAFGEPRE (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEPRE

SEQ ID NO: 257070 - protein, 23 aa, Artificial Sequence
  Description of Artificial Sequence: Synthetic peptide
  Seed: DVLSGIGVRAGREHFAFGEPREL (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEPREL

SEQ ID NO: 257071 - protein, 23 aa, Artificial Sequence
  Description of Artificial Sequence: Synthetic peptide
  Seed: DVLSGIGVRAGREHFAFGEPREL (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEPREL

SEQ ID NO: 257072 - protein, 23 aa, Artificial Sequence
  Description of Artificial Sequence: Synthetic peptide
  Seed: DVLSGIGVRAGREHFAFGEPREL (MAGC1_HUMAN)
  Core: AGREHFAFG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGVRXGRXHXAFXEPREL

SEQ ID NO: 257073 - protein, 23 aa, Artificial Sequence
  Description of Artificial Sequence: Synthetic peptide
  Seed: DVLSGIGVRAGREHFAFGEPREL (MAGC1_HUMAN)
  Core: FAFGEPREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGVRAGREHXAFXEXREX

SEQ ID NO: 257074 - protein, 24 aa, Artificial Sequence
  Description of Artificial Sequence: Synthetic peptide
  Seed: DVLSGIGVRAGREHFAFGEPRELL (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEPRELL

SEQ ID NO: 257075 - protein, 24 aa, Artificial Sequence
  Description of Artificial Sequence: Synthetic peptide
  Seed: DVLSGIGVRAGREHFAFGEPRELL (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEPRELL

SEQ ID NO: 257076 - protein, 24 aa, Artificial Sequence
  Description of Artificial Sequence: Synthetic peptide
  Seed: DVLSGIGVRAGREHFAFGEPRELL (MAGC1_HUMAN)
  Core: FAFGEPREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGVRAGREHXAFXEXREXL

SEQ ID NO: 257077 - protein, 25 aa, Artificial Sequence
  Description of Artificial Sequence: Synthetic peptide
  Seed: DVLSGIGVRAGREHFAFGEPRELLT (MAGC1_HUMAN)
  Core: LSGIGVRAG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
DVXSGXGXRAXREHFAFGEPRELLT

SEQ ID NO: 257078 - protein, 25 aa, Artificial Sequence
  Description of Artificial Sequence: Synthetic peptide
  Seed: DVLSGIGVRAGREHFAFGEPRELLT (MAGC1_HUMAN)
  Core: VRAGREHFA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGXRAXRXHFXFGEPRELLT

SEQ ID NO: 257079 - protein, 25 aa, Artificial Sequence
  Description of Artificial Sequence: Synthetic peptide
  Seed: DVLSGIGVRAGREHFAFGEPRELLT (MAGC1_HUMAN)
  Core: FAFGEPREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
DVLSGIGVRAGREHXAFXEXREXLT

SEQ ID NO: 257080 - protein, 15 aa, Artificial Sequence
  Description of Artificial Sequence: Synthetic peptide
  Seed: DVQSPLQNPASSFFS (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFX

SEQ ID NO: 257081 - protein, 16 aa, Artificial Sequence
  Description of Artificial Sequence: Synthetic peptide
  Seed: DVQSPLQNPASSFFSS (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXS

SEQ ID NO: 257082 - protein, 17 aa, Artificial Sequence
  Description of Artificial Sequence: Synthetic peptide
  Seed: DVQSPLQNPASSFFSSA (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSA

SEQ ID NO: 257083 - protein, 18 aa, Artificial Sequence
  Description of Artificial Sequence: Synthetic peptide
  Seed: DVQSPLQNPASSFFSSAL (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSAL

SEQ ID NO: 257084 - protein, 19 aa, Artificial Sequence
  Description of Artificial Sequence: Synthetic peptide
  Seed: DVQSPLQNPASSFFSSALL (MAGC1_HUMAN)
  Core: PLQNPASSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
DVQSXLQXPXSSXFSSALL

SEQ ID NO: 257085 - protein, 19 aa, Artificial Sequence
  Description of Artificial Sequence: Synthetic peptide
  Seed: DVQSPLQNPASSFFSSALL (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALL

SEQ ID NO: 257086 - protein, 19 aa, Artificial Sequence
  Description of Artificial Sequence: Synthetic peptide
  Seed: DVQSPLQNPASSFFSSALL (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXL

SEQ ID NO: 257087 - protein, 20 aa, Artificial Sequence
  Description of Artificial Sequence: Synthetic peptide
  Seed: DVQSPLQNPASSFFSSALLS (MAGC1_HUMAN)
  Core: LQNPASSFF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPXQNXAXSFXSSALLS

SEQ ID NO: 257088 - protein, 20 aa, Artificial Sequence
  Description of Artificial Sequence: Synthetic peptide
  Seed: DVQSPLQNPASSFFSSALLS (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLS

SEQ ID NO: 257089 - protein, 20 aa, Artificial Sequence
  Description of Artificial Sequence: Synthetic peptide
  Seed: DVQSPLQNPASSFFSSALLS (MAGC1_HUMAN)
  Core: PASSFFSSA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNXASXFXSSXLLS

SEQ ID NO: 257090 - protein, 20 aa, Artificial Sequence
  Description of Artificial Sequence: Synthetic peptide
  Seed: DVQSPLQNPASSFFSSALLS (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXLS

SEQ ID NO: 257091 - protein, 21 aa, Artificial Sequence
  Description of Artificial Sequence: Synthetic peptide
  Seed: DVQSPLQNPASSFFSSALLSI (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLSI

SEQ ID NO: 257092 - protein, 21 aa, Artificial Sequence
  Description of Artificial Sequence: Synthetic peptide
  Seed: DVQSPLQNPASSFFSSALLSI (MAGC1_HUMAN)
  Core: PASSFFSSA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNXASXFXSSXLLSI

SEQ ID NO: 257093 - protein, 21 aa, Artificial Sequence
  Description of Artificial Sequence: Synthetic peptide
  Seed: DVQSPLQNPASSFFSSALLSI (MAGC1_HUMAN)
  Core: SSFFSSALL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPAXSFXSXALXSI

SEQ ID NO: 257094 - protein, 21 aa, Artificial Sequence
  Description of Artificial Sequence: Synthetic peptide
  Seed: DVQSPLQNPASSFFSSALLSI (MAGC1_HUMAN)
  Core: FFSSALLSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASSXFSXAXLSX

SEQ ID NO: 257095 - protein, 22 aa, Artificial Sequence
  Description of Artificial Sequence: Synthetic peptide
  Seed: DVQSPLQNPASSFFSSALLSIF (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLSIF

SEQ ID NO: 257096 - protein, 22 aa, Artificial Sequence
  Description of Artificial Sequence: Synthetic peptide
  Seed: DVQSPLQNPASSFFSSALLSIF (MAGC1_HUMAN)
  Core: PASSFFSSA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNXASXFXSSXLLSIF

SEQ ID NO: 257097 - protein, 22 aa, Artificial Sequence
  Description of Artificial Sequence: Synthetic peptide
  Seed: DVQSPLQNPASSFFSSALLSIF (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXLSIF

SEQ ID NO: 257098 - protein, 22 aa, Artificial Sequence
  Description of Artificial Sequence: Synthetic peptide
  Seed: DVQSPLQNPASSFFSSALLSIF (MAGC1_HUMAN)
  Core: SSFFSSALL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPAXSFXSXALXSIF

SEQ ID NO: 257099 - protein, 22 aa, Artificial Sequence
  Description of Artificial Sequence: Synthetic peptide
  Seed: DVQSPLQNPASSFFSSALLSIF (MAGC1_HUMAN)
  Core: FFSSALLSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASSXFSXAXLSXF

SEQ ID NO: 257100 - protein, 23 aa, Artificial Sequence
  Description of Artificial Sequence: Synthetic peptide
  Seed: DVQSPLQNPASSFFSSALLSIFQ (MAGC1_HUMAN)
  Core: LQNPASSFF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPXQNXAXSFXSSALLSIFQ

SEQ ID NO: 257101 - protein, 23 aa, Artificial Sequence
  Description of Artificial Sequence: Synthetic peptide
  Seed: DVQSPLQNPASSFFSSALLSIFQ (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLSIFQ

SEQ ID NO: 257102 - protein, 23 aa, Artificial Sequence
  Description of Artificial Sequence: Synthetic peptide
  Seed: DVQSPLQNPASSFFSSALLSIFQ (MAGC1_HUMAN)
  Core: PASSFFSSA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNXASXFXSSXLLSIFQ

SEQ ID NO: 257103 - protein, 23 aa, Artificial Sequence
  Description of Artificial Sequence: Synthetic peptide
  Seed: DVQSPLQNPASSFFSSALLSIFQ (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXLSIFQ

SEQ ID NO: 257104 - protein, 23 aa, Artificial Sequence
  Description of Artificial Sequence: Synthetic peptide
  Seed: DVQSPLQNPASSFFSSALLSIFQ (MAGC1_HUMAN)
  Core: SSFFSSALL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPAXSFXSXALXSIFQ

SEQ ID NO: 257105 - protein, 23 aa, Artificial Sequence
  Description of Artificial Sequence: Synthetic peptide
  Seed: DVQSPLQNPASSFFSSALLSIFQ (MAGC1_HUMAN)
  Core: SFFSSALLS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASXFFXSXLLXIFQ

SEQ ID NO: 257106 - protein, 23 aa, Artificial Sequence
  Description of Artificial Sequence: Synthetic peptide
  Seed: DVQSPLQNPASSFFSSALLSIFQ (MAGC1_HUMAN)
  Core: FFSSALLSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASSXFSXAXLSXFQ

SEQ ID NO: 257107 - protein, 24 aa, Artificial Sequence
  Description of Artificial Sequence: Synthetic peptide
  Seed: DVQSPLQNPASSFFSSALLSIFQS (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLSIFQS

SEQ ID NO: 257108 - protein, 24 aa, Artificial Sequence
  Description of Artificial Sequence: Synthetic peptide
  Seed: DVQSPLQNPASSFFSSALLSIFQS (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXLSIFQS

SEQ ID NO: 257109 - protein, 24 aa, Artificial Sequence
  Description of Artificial Sequence: Synthetic peptide
  Seed: DVQSPLQNPASSFFSSALLSIFQS (MAGC1_HUMAN)
  Core: SSFFSSALL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPAXSFXSXALXSIFQS

SEQ ID NO: 257110 - protein, 24 aa, Artificial Sequence
  Description of Artificial Sequence: Synthetic peptide
  Seed: DVQSPLQNPASSFFSSALLSIFQS (MAGC1_HUMAN)
  Core: FFSSALLSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASSXFSXAXLSXFQS

SEQ ID NO: 257111 - protein, 25 aa, Artificial Sequence
  Description of Artificial Sequence: Synthetic peptide
  Seed: DVQSPLQNPASSFFSSALLSIFQSS (MAGC1_HUMAN)
  Core: QNPASSFFS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLXNPXSXFFXSALLSIFQSS

SEQ ID NO: 257112 - protein, 25 aa, Artificial Sequence
  Description of Artificial Sequence: Synthetic peptide
  Seed: DVQSPLQNPASSFFSSALLSIFQSS (MAGC1_HUMAN)
  Core: ASSFFSSAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPXSSXFXSAXLSIFQSS

SEQ ID NO: 257113 - protein, 25 aa, Artificial Sequence
  Description of Artificial Sequence: Synthetic peptide
  Seed: DVQSPLQNPASSFFSSALLSIFQSS (MAGC1_HUMAN)
  Core: SSFFSSALL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPAXSFXSXALXSIFQSS

SEQ ID NO: 257114 - protein, 25 aa, Artificial Sequence
  Description of Artificial Sequence: Synthetic peptide
  Seed: DVQSPLQNPASSFFSSALLSIFQSS (MAGC1_HUMAN)
  Core: FFSSALLSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
DVQSPLQNPASSXFSXAXLSXFQSS

SEQ ID NO: 257115 - protein, 15 aa, Artificial Sequence
  Description of Artificial Sequence: Synthetic peptide
  Seed: ECTQSTFEGFPQSPL (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPX

SEQ ID NO: 257116 - protein, 16 aa, Artificial Sequence
  Description of Artificial Sequence: Synthetic peptide
  Seed: ECTQSTFEGFPQSPLQ (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQ

SEQ ID NO: 257117 - protein, 17 aa, Artificial Sequence
  Description of Artificial Sequence: Synthetic peptide
  Seed: ECTQSTFEGFPQSPLQI (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQI

SEQ ID NO: 257118 - protein, 18 aa, Artificial Sequence
  Description of Artificial Sequence: Synthetic peptide
  Seed: ECTQSTFEGFPQSPLQIP (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIP

SEQ ID NO: 257119 - protein, 19 aa, Artificial Sequence
  Description of Artificial Sequence: Synthetic peptide
  Seed: ECTQSTFEGFPQSPLQIPQ (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQ

SEQ ID NO: 257120 - protein, 20 aa, Artificial Sequence
  Description of Artificial Sequence: Synthetic peptide
  Seed: ECTQSTFEGFPQSPLQIPQS (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQS

SEQ ID NO: 257121 - protein, 21 aa, Artificial Sequence
  Description of Artificial Sequence: Synthetic peptide
  Seed: ECTQSTFEGFPQSPLQIPQSP (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQSP

SEQ ID NO: 257122 - protein, 22 aa, Artificial Sequence
  Description of Artificial Sequence: Synthetic peptide
  Seed: ECTQSTFEGFPQSPLQIPQSPP (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQSPP

SEQ ID NO: 257123 - protein, 23 aa, Artificial Sequence
  Description of Artificial Sequence: Synthetic peptide
  Seed: ECTQSTFEGFPQSPLQIPQSPPE (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQSPPE

SEQ ID NO: 257124 - protein, 24 aa, Artificial Sequence
  Description of Artificial Sequence: Synthetic peptide
  Seed: ECTQSTFEGFPQSPLQIPQSPPEG (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQSPPEG

SEQ ID NO: 257125 - protein, 25 aa, Artificial Sequence
  Description of Artificial Sequence: Synthetic peptide
  Seed: ECTQSTFEGFPQSPLQIPQSPPEGE (MAGC1_HUMAN)
  Core: FEGFPQSPL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
ECTQSTXEGXPXSPXQIPQSPPEGE

SEQ ID NO: 257126 - protein, 13 aa, Artificial Sequence
  Description of Artificial Sequence: Synthetic peptide
  Seed: EDFQSSLQSPVSI (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSI

SEQ ID NO: 257127 - protein, 14 aa, Artificial Sequence
  Description of Artificial Sequence: Synthetic peptide
  Seed: EDFQSSLQSPVSIC (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSIC

SEQ ID NO: 257128 - protein, 15 aa, Artificial Sequence
  Description of Artificial Sequence: Synthetic peptide
  Seed: EDFQSSLQSPVSICS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICS

SEQ ID NO: 257129 - protein, 15 aa, Artificial Sequence
  Description of Artificial Sequence: Synthetic peptide
  Seed: EDFQSSLQSPVSICS (MAGC1_HUMAN)
  Core: QSSLQSPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDFXSSXQXPVXICS

SEQ ID NO: 257130 - protein, 16 aa, Artificial Sequence
  Description of Artificial Sequence: Synthetic peptide
  Seed: EDFQSSLQSPVSICSS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSS

SEQ ID NO: 257131 - protein, 16 aa, Artificial Sequence
  Description of Artificial Sequence: Synthetic peptide
  Seed: EDFQSSLQSPVSICSS (MAGC1_HUMAN)
  Core: QSSLQSPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDFXSSXQXPVXICSS

SEQ ID NO: 257132 - protein, 17 aa, Artificial Sequence
  Description of Artificial Sequence: Synthetic peptide
  Seed: EDFQSSLQSPVSICSSS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSS

SEQ ID NO: 257133 - protein, 17 aa, Artificial Sequence
  Description of Artificial Sequence: Synthetic peptide
  Seed: EDFQSSLQSPVSICSSS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSS

SEQ ID NO: 257134 - protein, 17 aa, Artificial Sequence
  Description of Artificial Sequence: Synthetic peptide
  Seed: EDFQSSLQSPVSICSSS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXS

SEQ ID NO: 257135 - protein, 19 aa, Artificial Sequence
  Description of Artificial Sequence: Synthetic peptide
  Seed: EDFQSSLQSPVSICSSSTS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTS

SEQ ID NO: 257136 - protein, 19 aa, Artificial Sequence
  Description of Artificial Sequence: Synthetic peptide
  Seed: EDFQSSLQSPVSICSSSTS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTS

SEQ ID NO: 257137 - protein, 19 aa, Artificial Sequence
  Description of Artificial Sequence: Synthetic peptide
  Seed: EDFQSSLQSPVSICSSSTS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTS

SEQ ID NO: 257138 - protein, 20 aa, Artificial Sequence
  Description of Artificial Sequence: Synthetic peptide
  Seed: EDFQSSLQSPVSICSSSTSL (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSL

SEQ ID NO: 257139 - protein, 20 aa, Artificial Sequence
  Description of Artificial Sequence: Synthetic peptide
  Seed: EDFQSSLQSPVSICSSSTSL (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSL

SEQ ID NO: 257140 - protein, 20 aa, Artificial Sequence
  Description of Artificial Sequence: Synthetic peptide
  Seed: EDFQSSLQSPVSICSSSTSL (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTSL

SEQ ID NO: 257141 - protein, 21 aa, Artificial Sequence
  Description of Artificial Sequence: Synthetic peptide
  Seed: EDFQSSLQSPVSICSSSTSLS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSLS

SEQ ID NO: 257142 - protein, 21 aa, Artificial Sequence
  Description of Artificial Sequence: Synthetic peptide
  Seed: EDFQSSLQSPVSICSSSTSLS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSLS

SEQ ID NO: 257143 - protein, 21 aa, Artificial Sequence
  Description of Artificial Sequence: Synthetic peptide
  Seed: EDFQSSLQSPVSICSSSTSLS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTSLS

SEQ ID NO: 257144 - protein, 21 aa, Artificial Sequence
  Description of Artificial Sequence: Synthetic peptide
  Seed: EDFQSSLQSPVSICSSSTSLS (MAGC1_HUMAN)
  Core: ICSSSTSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSXCSXSXSLX

SEQ ID NO: 257145 - protein, 22 aa, Artificial Sequence
  Description of Artificial Sequence: Synthetic peptide
  Seed: EDFQSSLQSPVSICSSSTSLSL (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSLSL

SEQ ID NO: 257146 - protein, 22 aa, Artificial Sequence
  Description of Artificial Sequence: Synthetic peptide
  Seed: EDFQSSLQSPVSICSSSTSLSL (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSLSL

SEQ ID NO: 257147 - protein, 22 aa, Artificial Sequence
  Description of Artificial Sequence: Synthetic peptide
  Seed: EDFQSSLQSPVSICSSSTSLSL (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTSLSL

SEQ ID NO: 257148 - protein, 22 aa, Artificial Sequence
  Description of Artificial Sequence: Synthetic peptide
  Seed: EDFQSSLQSPVSICSSSTSLSL (MAGC1_HUMAN)
  Core: ICSSSTSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSXCSXSXSLXL

SEQ ID NO: 257149 - protein, 23 aa, Artificial Sequence
  Description of Artificial Sequence: Synthetic peptide
  Seed: EDFQSSLQSPVSICSSSTSLSLP (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSLSLP

SEQ ID NO: 257150 - protein, 23 aa, Artificial Sequence
  Description of Artificial Sequence: Synthetic peptide
  Seed: EDFQSSLQSPVSICSSSTSLSLP (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSLSLP

SEQ ID NO: 257151 - protein, 23 aa, Artificial Sequence
  Description of Artificial Sequence: Synthetic peptide
  Seed: EDFQSSLQSPVSICSSSTSLSLP (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTSLSLP

SEQ ID NO: 257152 - protein, 23 aa, Artificial Sequence
  Description of Artificial Sequence: Synthetic peptide
  Seed: EDFQSSLQSPVSICSSSTSLSLP (MAGC1_HUMAN)
  Core: VSICSSSTS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPXSIXSXSTXLSLP

SEQ ID NO: 257153 - protein, 23 aa, Artificial Sequence
  Description of Artificial Sequence: Synthetic peptide
  Seed: EDFQSSLQSPVSICSSSTSLSLP (MAGC1_HUMAN)
  Core: ICSSSTSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSXCSXSXSLXLP

SEQ ID NO: 257154 - protein, 23 aa, Artificial Sequence
  Description of Artificial Sequence: Synthetic peptide
  Seed: EDFQSSLQSPVSICSSSTSLSLP (MAGC1_HUMAN)
  Core: CSSSTSLSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSIXSSXTXLSXP

SEQ ID NO: 257155 - protein, 24 aa, Artificial Sequence
  Description of Artificial Sequence: Synthetic peptide
  Seed: EDFQSSLQSPVSICSSSTSLSLPQ (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSLSLPQ

SEQ ID NO: 257156 - protein, 24 aa, Artificial Sequence
  Description of Artificial Sequence: Synthetic peptide
  Seed: EDFQSSLQSPVSICSSSTSLSLPQ (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSLSLPQ

SEQ ID NO: 257157 - protein, 24 aa, Artificial Sequence
  Description of Artificial Sequence: Synthetic peptide
  Seed: EDFQSSLQSPVSICSSSTSLSLPQ (MAGC1_HUMAN)
  Core: VSICSSSTS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPXSIXSXSTXLSLPQ

SEQ ID NO: 257158 - protein, 24 aa, Artificial Sequence
  Description of Artificial Sequence: Synthetic peptide
  Seed: EDFQSSLQSPVSICSSSTSLSLPQ (MAGC1_HUMAN)
  Core: ICSSSTSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSXCSXSXSLXLPQ

SEQ ID NO: 257159 - protein, 24 aa, Artificial Sequence
  Description of Artificial Sequence: Synthetic peptide
  Seed: EDFQSSLQSPVSICSSSTSLSLPQ (MAGC1_HUMAN)
  Core: CSSSTSLSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSIXSSXTXLSXPQ

SEQ ID NO: 257160 - protein, 25 aa, Artificial Sequence
  Description of Artificial Sequence: Synthetic peptide
  Seed: EDFQSSLQSPVSICSSSTSLSLPQS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EDXQSXLXSPXSICSSSTSLSLPQS

SEQ ID NO: 257161 - protein, 25 aa, Artificial Sequence
  Description of Artificial Sequence: Synthetic peptide
  Seed: EDFQSSLQSPVSICSSSTSLSLPQS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSXQSXVXICXSSTSLSLPQS

SEQ ID NO: 257162 - protein, 25 aa, Artificial Sequence
  Description of Artificial Sequence: Synthetic peptide
  Seed: EDFQSSLQSPVSICSSSTSLSLPQS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLXSPXSXCSXSTSLSLPQS

SEQ ID NO: 257163 - protein, 25 aa, Artificial Sequence
  Description of Artificial Sequence: Synthetic peptide
  Seed: EDFQSSLQSPVSICSSSTSLSLPQS (MAGC1_HUMAN)
  Core: ICSSSTSLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSXCSXSXSLXLPQS

SEQ ID NO: 257164 - protein, 25 aa, Artificial Sequence
  Description of Artificial Sequence: Synthetic peptide
  Seed: EDFQSSLQSPVSICSSSTSLSLPQS (MAGC1_HUMAN)
  Core: CSSSTSLSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDFQSSLQSPVSIXSSXTXLSXPQS

SEQ ID NO: 257165 - protein, 15 aa, Artificial Sequence
  Description of Artificial Sequence: Synthetic peptide
  Seed: EDSLSPLHFPQFPPQ (MAGC1_HUMAN)
  Core: LSPLHFPQF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXHXPQXPPQ

SEQ ID NO: 257166 - protein, 16 aa, Artificial Sequence
  Description of Artificial Sequence: Synthetic peptide
  Seed: EDSLSPLHFPQFPPQG (MAGC1_HUMAN)
  Core: LSPLHFPQF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXHXPQXPPQG

SEQ ID NO: 257167 - protein, 17 aa, Artificial Sequence
  Description of Artificial Sequence: Synthetic peptide
  Seed: EDSLSPLHFPQFPPQGE (MAGC1_HUMAN)
  Core: LSPLHFPQF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXHXPQXPPQGE

SEQ ID NO: 257168 - protein, 20 aa, Artificial Sequence
  Description of Artificial Sequence: Synthetic peptide
  Seed: EDSLSPLHFPQFPPQGEDFQ (MAGC1_HUMAN)
  Core: LSPLHFPQF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXHXPQXPPQGEDFQ

SEQ ID NO: 257169 - protein, 20 aa, Artificial Sequence
  Description of Artificial Sequence: Synthetic peptide
  Seed: EDSLSPLHFPQFPPQGEDFQ (MAGC1_HUMAN)
  Core: LHFPQFPPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDSLSPXHFXQXPPXGEDFQ

SEQ ID NO: 257170 - protein, 22 aa, Artificial Sequence
  Description of Artificial Sequence: Synthetic peptide
  Seed: EDSLSPLHFPQFPPQGEDFQSS (MAGC1_HUMAN)
  Core: LHFPQFPPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDSLSPXHFXQXPPXGEDFQSS

SEQ ID NO: 257171 - protein, 23 aa, Artificial Sequence
  Description of Artificial Sequence: Synthetic peptide
  Seed: EDSLSPLHFPQFPPQGEDFQSSL (MAGC1_HUMAN)
  Core: LHFPQFPPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDSLSPXHFXQXPPXGEDFQSSL

SEQ ID NO: 257172 - protein, 24 aa, Artificial Sequence
  Description of Artificial Sequence: Synthetic peptide
  Seed: EDSLSPLHFPQFPPQGEDFQSSLQ (MAGC1_HUMAN)
  Core: LHFPQFPPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDSLSPXHFXQXPPXGEDFQSSLQ

SEQ ID NO: 257173 - protein, 25 aa, Artificial Sequence
  Description of Artificial Sequence: Synthetic peptide
  Seed: EDSLSPLHFPQFPPQGEDFQSSLQS (MAGC1_HUMAN)
  Core: LSPLHFPQF
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXHXPQXPPQGEDFQSSLQS

SEQ ID NO: 257174 - protein, 25 aa, Artificial Sequence
  Description of Artificial Sequence: Synthetic peptide
  Seed: EDSLSPLHFPQFPPQGEDFQSSLQS (MAGC1_HUMAN)
  Core: LHFPQFPPQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDSLSPXHFXQXPPXGEDFQSSLQS

SEQ ID NO: 257175 - protein, 14 aa, Artificial Sequence
  Description of Artificial Sequence: Synthetic peptide
  Seed: EDSLSPLQIPQSPL (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPL

SEQ ID NO: 257176 - protein, 15 aa, Artificial Sequence
  Description of Artificial Sequence: Synthetic peptide
  Seed: EDSLSPLQIPQSPLE (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLE

SEQ ID NO: 257177 - protein, 16 aa, Artificial Sequence
  Description of Artificial Sequence: Synthetic peptide
  Seed: EDSLSPLQIPQSPLEG (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLEG

SEQ ID NO: 257178 - protein, 17 aa, Artificial Sequence
  Description of Artificial Sequence: Synthetic peptide
  Seed: EDSLSPLQIPQSPLEGE (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLEGE

SEQ ID NO: 257179 - protein, 20 aa, Artificial Sequence
  Description of Artificial Sequence: Synthetic peptide
  Seed: EDSLSPLQIPQSPLEGEDSL (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLEGEDSL

SEQ ID NO: 257180 - protein, 24 aa, Artificial Sequence
  Description of Artificial Sequence: Synthetic peptide
  Seed: EDSLSPLQIPQSPLEGEDSLSSLH (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLEGEDSLSSLH

SEQ ID NO: 257181 - protein, 25 aa, Artificial Sequence
  Description of Artificial Sequence: Synthetic peptide
  Seed: EDSLSPLQIPQSPLEGEDSLSSLHF (MAGC1_HUMAN)
  Core: LSPLQIPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXQXPQXPLEGEDSLSSLHF

SEQ ID NO: 257182 - protein, 14 aa, Artificial Sequence
  Description of Artificial Sequence: Synthetic peptide
  Seed: EDSLSSLHFPQSPP (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPP

SEQ ID NO: 257183 - protein, 15 aa, Artificial Sequence
  Description of Artificial Sequence: Synthetic peptide
  Seed: EDSLSSLHFPQSPPE (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPE

SEQ ID NO: 257184 - protein, 16 aa, Artificial Sequence
  Description of Artificial Sequence: Synthetic peptide
  Seed: EDSLSSLHFPQSPPEW (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEW

SEQ ID NO: 257185 - protein, 17 aa, Artificial Sequence
  Description of Artificial Sequence: Synthetic peptide
  Seed: EDSLSSLHFPQSPPEWE (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWE

SEQ ID NO: 257186 - protein, 19 aa, Artificial Sequence
  Description of Artificial Sequence: Synthetic peptide
  Seed: EDSLSSLHFPQSPPEWEDS (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDS

SEQ ID NO: 257187 - protein, 20 aa, Artificial Sequence
  Description of Artificial Sequence: Synthetic peptide
  Seed: EDSLSSLHFPQSPPEWEDSL (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSL

SEQ ID NO: 257188 - protein, 21 aa, Artificial Sequence
  Description of Artificial Sequence: Synthetic peptide
  Seed: EDSLSSLHFPQSPPEWEDSLS (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSLS

SEQ ID NO: 257189 - protein, 22 aa, Artificial Sequence
  Description of Artificial Sequence: Synthetic peptide
  Seed: EDSLSSLHFPQSPPEWEDSLSP (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSLSP

SEQ ID NO: 257190 - protein, 23 aa, Artificial Sequence
  Description of Artificial Sequence: Synthetic peptide
  Seed: EDSLSSLHFPQSPPEWEDSLSPL (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSLSPL

SEQ ID NO: 257191 - protein, 24 aa, Artificial Sequence
  Description of Artificial Sequence: Synthetic peptide
  Seed: EDSLSSLHFPQSPPEWEDSLSPLH (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSLSPLH

SEQ ID NO: 257192 - protein, 25 aa, Artificial Sequence
  Description of Artificial Sequence: Synthetic peptide
  Seed: EDSLSSLHFPQSPPEWEDSLSPLHF (MAGC1_HUMAN)
  Core: LSSLHFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSSXHXPQXPPEWEDSLSPLHF

SEQ ID NO: 257193 - protein, 15 aa, Artificial Sequence
  Description of Artificial Sequence: Synthetic peptide
  Seed: EDSMSPLYFPQSPLQ (MAGC1_HUMAN)
  Core: MSPLYFPQS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EDSXSPXYXPQXPLQ

SEQ ID NO: 257194 - protein, 16 aa, Artificial Sequence
  Description of Artificial Sequence: Synthetic peptide
  Seed: EDSMSPLYFPQSPLQG (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQX

SEQ ID NO: 257195 - protein, 17 aa, Artificial Sequence
  Description of Artificial Sequence: Synthetic peptide
  Seed: EDSMSPLYFPQSPLQGE (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXE

SEQ ID NO: 257196 - protein, 18 aa, Artificial Sequence
  Description of Artificial Sequence: Synthetic peptide
  Seed: EDSMSPLYFPQSPLQGEE (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEE

SEQ ID NO: 257197 - protein, 19 aa, Artificial Sequence
  Description of Artificial Sequence: Synthetic peptide
  Seed: EDSMSPLYFPQSPLQGEEF (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEF

SEQ ID NO: 257198 - protein, 20 aa, Artificial Sequence
  Description of Artificial Sequence: Synthetic peptide
  Seed: EDSMSPLYFPQSPLQGEEFQ (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQ

SEQ ID NO: 257199 - protein, 21 aa, Artificial Sequence
  Description of Artificial Sequence: Synthetic peptide
  Seed: EDSMSPLYFPQSPLQGEEFQS (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQS

SEQ ID NO: 257200 - protein, 22 aa, Artificial Sequence
  Description of Artificial Sequence: Synthetic peptide
  Seed: EDSMSPLYFPQSPLQGEEFQSS (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQSS

SEQ ID NO: 257201 - protein, 22 aa, Artificial Sequence
  Description of Artificial Sequence: Synthetic peptide
  Seed: EDSMSPLYFPQSPLQGEEFQSS (MAGC1_HUMAN)
  Core: LQGEEFQSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLYFPQSPXQGXEXQSX

SEQ ID NO: 257202 - protein, 23 aa, Artificial Sequence
  Description of Artificial Sequence: Synthetic peptide
  Seed: EDSMSPLYFPQSPLQGEEFQSSL (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQSSL

SEQ ID NO: 257203 - protein, 23 aa, Artificial Sequence
  Description of Artificial Sequence: Synthetic peptide
  Seed: EDSMSPLYFPQSPLQGEEFQSSL (MAGC1_HUMAN)
  Core: LQGEEFQSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLYFPQSPXQGXEXQSXL

SEQ ID NO: 257204 - protein, 24 aa, Artificial Sequence
  Description of Artificial Sequence: Synthetic peptide
  Seed: EDSMSPLYFPQSPLQGEEFQSSLQ (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQSSLQ

SEQ ID NO: 257205 - protein, 24 aa, Artificial Sequence
  Description of Artificial Sequence: Synthetic peptide
  Seed: EDSMSPLYFPQSPLQGEEFQSSLQ (MAGC1_HUMAN)
  Core: LQGEEFQSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLYFPQSPXQGXEXQSXLQ

SEQ ID NO: 257206 - protein, 25 aa, Artificial Sequence
  Description of Artificial Sequence: Synthetic peptide
  Seed: EDSMSPLYFPQSPLQGEEFQSSLQS (MAGC1_HUMAN)
  Core: YFPQSPLQG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLXFPXSXLQXEEFQSSLQS

SEQ ID NO: 257207 - protein, 25 aa, Artificial Sequence
  Description of Artificial Sequence: Synthetic peptide
  Seed: EDSMSPLYFPQSPLQGEEFQSSLQS (MAGC1_HUMAN)
  Core: LQGEEFQSS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDSMSPLYFPQSPXQGXEXQSXLQS

SEQ ID NO: 257208 - protein, 19 aa, Artificial Sequence
  Description of Artificial Sequence: Synthetic peptide
  Seed: EDVQSPLQNPASSFFSSAL (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSAL

SEQ ID NO: 257209 - protein, 20 aa, Artificial Sequence
  Description of Artificial Sequence: Synthetic peptide
  Seed: EDVQSPLQNPASSFFSSALL (MAGC1_HUMAN)
  Core: PLQNPASSF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSXLQXPXSSXFSSALL

SEQ ID NO: 257210 - protein, 20 aa, Artificial Sequence
  Description of Artificial Sequence: Synthetic peptide
  Seed: EDVQSPLQNPASSFFSSALL (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALL

SEQ ID NO: 257211 - protein, 20 aa, Artificial Sequence
  Description of Artificial Sequence: Synthetic peptide
  Seed: EDVQSPLQNPASSFFSSALL (MAGC1_HUMAN)
  Core: PASSFFSSA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNXASXFXSSXLL

SEQ ID NO: 257212 - protein, 20 aa, Artificial Sequence
  Description of Artificial Sequence: Synthetic peptide
  Seed: EDVQSPLQNPASSFFSSALL (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXL

SEQ ID NO: 257213 - protein, 21 aa, Artificial Sequence
  Description of Artificial Sequence: Synthetic peptide
  Seed: EDVQSPLQNPASSFFSSALLS (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALLS

SEQ ID NO: 257214 - protein, 21 aa, Artificial Sequence
  Description of Artificial Sequence: Synthetic peptide
  Seed: EDVQSPLQNPASSFFSSALLS (MAGC1_HUMAN)
  Core: PASSFFSSA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNXASXFXSSXLLS

SEQ ID NO: 257215 - protein, 21 aa, Artificial Sequence
  Description of Artificial Sequence: Synthetic peptide
  Seed: EDVQSPLQNPASSFFSSALLS (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXLS

SEQ ID NO: 257216 - protein, 21 aa, Artificial Sequence
  Description of Artificial Sequence: Synthetic peptide
  Seed: EDVQSPLQNPASSFFSSALLS (MAGC1_HUMAN)
  Core: SSFFSSALL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPAXSFXSXALXS

SEQ ID NO: 257217 - protein, 22 aa, Artificial Sequence
  Description of Artificial Sequence: Synthetic peptide
  Seed: EDVQSPLQNPASSFFSSALLSI (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALLSI

SEQ ID NO: 257218 - protein, 22 aa, Artificial Sequence
  Description of Artificial Sequence: Synthetic peptide
  Seed: EDVQSPLQNPASSFFSSALLSI (MAGC1_HUMAN)
  Core: PASSFFSSA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNXASXFXSSXLLSI

SEQ ID NO: 257219 - protein, 22 aa, Artificial Sequence
  Description of Artificial Sequence: Synthetic peptide
  Seed: EDVQSPLQNPASSFFSSALLSI (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXLSI

SEQ ID NO: 257220 - protein, 22 aa, Artificial Sequence
  Description of Artificial Sequence: Synthetic peptide
  Seed: EDVQSPLQNPASSFFSSALLSI (MAGC1_HUMAN)
  Core: SSFFSSALL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPAXSFXSXALXSI

SEQ ID NO: 257221 - protein, 22 aa, Artificial Sequence
  Description of Artificial Sequence: Synthetic peptide
  Seed: EDVQSPLQNPASSFFSSALLSI (MAGC1_HUMAN)
  Core: FFSSALLSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPASSXFSXAXLSX

SEQ ID NO: 257222 - protein, 23 aa, Artificial Sequence
  Description of Artificial Sequence: Synthetic peptide
  Seed: EDVQSPLQNPASSFFSSALLSIF (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALLSIF

SEQ ID NO: 257223 - protein, 23 aa, Artificial Sequence
  Description of Artificial Sequence: Synthetic peptide
  Seed: EDVQSPLQNPASSFFSSALLSIF (MAGC1_HUMAN)
  Core: PASSFFSSA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNXASXFXSSXLLSIF

SEQ ID NO: 257224 - protein, 23 aa, Artificial Sequence
  Description of Artificial Sequence: Synthetic peptide
  Seed: EDVQSPLQNPASSFFSSALLSIF (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXLSIF

SEQ ID NO: 257225 - protein, 23 aa, Artificial Sequence
  Description of Artificial Sequence: Synthetic peptide
  Seed: EDVQSPLQNPASSFFSSALLSIF (MAGC1_HUMAN)
  Core: SSFFSSALL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPAXSFXSXALXSIF

SEQ ID NO: 257226 - protein, 23 aa, Artificial Sequence
  Description of Artificial Sequence: Synthetic peptide
  Seed: EDVQSPLQNPASSFFSSALLSIF (MAGC1_HUMAN)
  Core: FFSSALLSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPASSXFSXAXLSXF

SEQ ID NO: 257227 - protein, 24 aa, Artificial Sequence
  Description of Artificial Sequence: Synthetic peptide
  Seed: EDVQSPLQNPASSFFSSALLSIFQ (MAGC1_HUMAN)
  Core: LQNPASSFF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPXQNXAXSFXSSALLSIFQ

SEQ ID NO: 257228 - protein, 24 aa, Artificial Sequence
  Description of Artificial Sequence: Synthetic peptide
  Seed: EDVQSPLQNPASSFFSSALLSIFQ (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALLSIFQ

SEQ ID NO: 257229 - protein, 24 aa, Artificial Sequence
  Description of Artificial Sequence: Synthetic peptide
  Seed: EDVQSPLQNPASSFFSSALLSIFQ (MAGC1_HUMAN)
  Core: PASSFFSSA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNXASXFXSSXLLSIFQ

SEQ ID NO: 257230 - protein, 24 aa, Artificial Sequence
  Description of Artificial Sequence: Synthetic peptide
  Seed: EDVQSPLQNPASSFFSSALLSIFQ (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXLSIFQ

SEQ ID NO: 257231 - protein, 24 aa, Artificial Sequence
  Description of Artificial Sequence: Synthetic peptide
  Seed: EDVQSPLQNPASSFFSSALLSIFQ (MAGC1_HUMAN)
  Core: SSFFSSALL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPAXSFXSXALXSIFQ

SEQ ID NO: 257232 - protein, 24 aa, Artificial Sequence
  Description of Artificial Sequence: Synthetic peptide
  Seed: EDVQSPLQNPASSFFSSALLSIFQ (MAGC1_HUMAN)
  Core: SFFSSALLS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPASXFFXSXLLXIFQ

SEQ ID NO: 257233 - protein, 24 aa, Artificial Sequence
  Description of Artificial Sequence: Synthetic peptide
  Seed: EDVQSPLQNPASSFFSSALLSIFQ (MAGC1_HUMAN)
  Core: FFSSALLSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPASSXFSXAXLSXFQ

SEQ ID NO: 257234 - protein, 25 aa, Artificial Sequence
  Description of Artificial Sequence: Synthetic peptide
  Seed: EDVQSPLQNPASSFFSSALLSIFQS (MAGC1_HUMAN)
  Core: QNPASSFFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLXNPXSXFFXSALLSIFQS

SEQ ID NO: 257235 - protein, 25 aa, Artificial Sequence
  Description of Artificial Sequence: Synthetic peptide
  Seed: EDVQSPLQNPASSFFSSALLSIFQS (MAGC1_HUMAN)
  Core: ASSFFSSAL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPXSSXFXSAXLSIFQS

SEQ ID NO: 257236 - protein, 25 aa, Artificial Sequence
  Description of Artificial Sequence: Synthetic peptide
  Seed: EDVQSPLQNPASSFFSSALLSIFQS (MAGC1_HUMAN)
  Core: SSFFSSALL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPAXSFXSXALXSIFQS

SEQ ID NO: 257237 - protein, 25 aa, Artificial Sequence
  Description of Artificial Sequence: Synthetic peptide
  Seed: EDVQSPLQNPASSFFSSALLSIFQS (MAGC1_HUMAN)
  Core: FFSSALLSI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EDVQSPLQNPASSXFSXAXLSXFQS

SEQ ID NO: 257238 - protein, 13 aa, Artificial Sequence
  Description of Artificial Sequence: Synthetic peptide
  Seed: EEFQSSLQSPVSI (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSI

SEQ ID NO: 257239 - protein, 14 aa, Artificial Sequence
  Description of Artificial Sequence: Synthetic peptide
  Seed: EEFQSSLQSPVSIC (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSIC

SEQ ID NO: 257240 - protein, 15 aa, Artificial Sequence
  Description of Artificial Sequence: Synthetic peptide
  Seed: EEFQSSLQSPVSICS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICS

SEQ ID NO: 257241 - protein, 15 aa, Artificial Sequence
  Description of Artificial Sequence: Synthetic peptide
  Seed: EEFQSSLQSPVSICS (MAGC1_HUMAN)
  Core: QSSLQSPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEFXSSXQXPVXICS

SEQ ID NO: 257242 - protein, 16 aa, Artificial Sequence
  Description of Artificial Sequence: Synthetic peptide
  Seed: EEFQSSLQSPVSICSS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSS

SEQ ID NO: 257243 - protein, 16 aa, Artificial Sequence
  Description of Artificial Sequence: Synthetic peptide
  Seed: EEFQSSLQSPVSICSS (MAGC1_HUMAN)
  Core: QSSLQSPVS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEFXSSXQXPVXICSS

SEQ ID NO: 257244 - protein, 17 aa, Artificial Sequence
  Description of Artificial Sequence: Synthetic peptide
  Seed: EEFQSSLQSPVSICSSS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSS

SEQ ID NO: 257245 - protein, 17 aa, Artificial Sequence
  Description of Artificial Sequence: Synthetic peptide
  Seed: EEFQSSLQSPVSICSSS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSS

SEQ ID NO: 257246 - protein, 17 aa, Artificial Sequence
  Description of Artificial Sequence: Synthetic peptide
  Seed: EEFQSSLQSPVSICSSS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXS

SEQ ID NO: 257247 - protein, 19 aa, Artificial Sequence
  Description of Artificial Sequence: Synthetic peptide
  Seed: EEFQSSLQSPVSICSSSTP (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTP

SEQ ID NO: 257248 - protein, 19 aa, Artificial Sequence
  Description of Artificial Sequence: Synthetic peptide
  Seed: EEFQSSLQSPVSICSSSTP (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTP

SEQ ID NO: 257249 - protein, 19 aa, Artificial Sequence
  Description of Artificial Sequence: Synthetic peptide
  Seed: EEFQSSLQSPVSICSSSTP (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXSTP

SEQ ID NO: 257250 - protein, 20 aa, Artificial Sequence
  Description of Artificial Sequence: Synthetic peptide
  Seed: EEFQSSLQSPVSICSSSTPS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPS

SEQ ID NO: 257251 - protein, 20 aa, Artificial Sequence
  Description of Artificial Sequence: Synthetic peptide
  Seed: EEFQSSLQSPVSICSSSTPS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPS

SEQ ID NO: 257252 - protein, 20 aa, Artificial Sequence
  Description of Artificial Sequence: Synthetic peptide
  Seed: EEFQSSLQSPVSICSSSTPS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXSTPS

SEQ ID NO: 257253 - protein, 21 aa, Artificial Sequence
  Description of Artificial Sequence: Synthetic peptide
  Seed: EEFQSSLQSPVSICSSSTPSS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPSS

SEQ ID NO: 257254 - protein, 21 aa, Artificial Sequence
  Description of Artificial Sequence: Synthetic peptide
  Seed: EEFQSSLQSPVSICSSSTPSS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPSS

SEQ ID NO: 257255 - protein, 21 aa, Artificial Sequence
  Description of Artificial Sequence: Synthetic peptide
  Seed: EEFQSSLQSPVSICSSSTPSS (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXSTPSS

SEQ ID NO: 257256 - protein, 22 aa, Artificial Sequence
  Description of Artificial Sequence: Synthetic peptide
  Seed: EEFQSSLQSPVSICSSSTPSSL (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPSSL

SEQ ID NO: 257257 - protein, 22 aa, Artificial Sequence
  Description of Artificial Sequence: Synthetic peptide
  Seed: EEFQSSLQSPVSICSSSTPSSL (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPSSL

SEQ ID NO: 257258 - protein, 22 aa, Artificial Sequence
  Description of Artificial Sequence: Synthetic peptide
  Seed: EEFQSSLQSPVSICSSSTPSSL (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXSTPSSL

SEQ ID NO: 257259 - protein, 22 aa, Artificial Sequence
  Description of Artificial Sequence: Synthetic peptide
  Seed: EEFQSSLQSPVSICSSSTPSSL (MAGC1_HUMAN)
  Core: ICSSSTPSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLQSPVSXCSXSXPSXL

SEQ ID NO: 257260 - protein, 23 aa, Artificial Sequence
  Description of Artificial Sequence: Synthetic peptide
  Seed: EEFQSSLQSPVSICSSSTPSSLP (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPSSLP

SEQ ID NO: 257261 - protein, 23 aa, Artificial Sequence
  Description of Artificial Sequence: Synthetic peptide
  Seed: EEFQSSLQSPVSICSSSTPSSLP (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPSSLP

SEQ ID NO: 257262 - protein, 23 aa, Artificial Sequence
  Description of Artificial Sequence: Synthetic peptide
  Seed: EEFQSSLQSPVSICSSSTPSSLP (MAGC1_HUMAN)
  Core: QSPVSICSS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLXSPXSXCSXSTPSSLP

SEQ ID NO: 257263 - protein, 23 aa, Artificial Sequence
  Description of Artificial Sequence: Synthetic peptide
  Seed: EEFQSSLQSPVSICSSSTPSSLP (MAGC1_HUMAN)
  Core: ICSSSTPSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLQSPVSXCSXSXPSXLP

SEQ ID NO: 257264 - protein, 24 aa, Artificial Sequence
  Description of Artificial Sequence: Synthetic peptide
  Seed: EEFQSSLQSPVSICSSSTPSSLPQ (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPSSLPQ

SEQ ID NO: 257265 - protein, 24 aa, Artificial Sequence
  Description of Artificial Sequence: Synthetic peptide
  Seed: EEFQSSLQSPVSICSSSTPSSLPQ (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPSSLPQ

SEQ ID NO: 257266 - protein, 24 aa, Artificial Sequence
  Description of Artificial Sequence: Synthetic peptide
  Seed: EEFQSSLQSPVSICSSSTPSSLPQ (MAGC1_HUMAN)
  Core: ICSSSTPSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLQSPVSXCSXSXPSXLPQ

SEQ ID NO: 257267 - protein, 25 aa, Artificial Sequence
  Description of Artificial Sequence: Synthetic peptide
  Seed: EEFQSSLQSPVSICSSSTPSSLPQS (MAGC1_HUMAN)
  Core: FQSSLQSPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXQSXLXSPXSICSSSTPSSLPQS

SEQ ID NO: 257268 - protein, 25 aa, Artificial Sequence
  Description of Artificial Sequence: Synthetic peptide
  Seed: EEFQSSLQSPVSICSSSTPSSLPQS (MAGC1_HUMAN)
  Core: LQSPVSICS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSXQSXVXICXSSTPSSLPQS

SEQ ID NO: 257269 - protein, 25 aa, Artificial Sequence
  Description of Artificial Sequence: Synthetic peptide
  Seed: EEFQSSLQSPVSICSSSTPSSLPQS (MAGC1_HUMAN)
  Core: ICSSSTPSS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLQSPVSXCSXSXPSXLPQS

SEQ ID NO: 257270 - protein, 25 aa, Artificial Sequence
  Description of Artificial Sequence: Synthetic peptide
  Seed: EEFQSSLQSPVSICSSSTPSSLPQS (MAGC1_HUMAN)
  Core: CSSSTPSSL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EEFQSSLQSPVSIXSSXTXSSXPQS

SEQ ID NO: 257271 - protein, 16 aa, Artificial Sequence
  Description of Artificial Sequence: Synthetic peptide
  Seed: EERAQAIIDTTDDSTA (MAGC1_HUMAN)
  Core: AQAIIDTTD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EERXQAXIXTTXDSTA

SEQ ID NO: 257272 - protein, 20 aa, Artificial Sequence
  Description of Artificial Sequence: Synthetic peptide
  Seed: EERAQAIIDTTDDSTATESA (MAGC1_HUMAN)
  Core: IDTTDDSTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EERAQAIXDTXDXSTXTESA

SEQ ID NO: 257273 - protein, 24 aa, Artificial Sequence
  Description of Artificial Sequence: Synthetic peptide
  Seed: EERAQAIIDTTDDSTATESASSSV (MAGC1_HUMAN)
  Core: STATESASS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EERAQAIIDTTDDXTAXEXASXSV

SEQ ID NO: 257274 - protein, 25 aa, Artificial Sequence
  Description of Artificial Sequence: Synthetic peptide
  Seed: EERAQAIIDTTDDSTATESASSSVM (MAGC1_HUMAN)
  Core: STATESASS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EERAQAIIDTTDDXTAXEXASXSVM

SEQ ID NO: 257275 - protein, 20 aa, Artificial Sequence
  Description of Artificial Sequence: Synthetic peptide
  Seed: EESSSPVDEYTSSSDTLLES (MAGC1_HUMAN)
  Core: YTSSSDTLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EESSSPVDEXTSXSXTLXES

SEQ ID NO: 257276 - protein, 22 aa, Artificial Sequence
  Description of Artificial Sequence: Synthetic peptide
  Seed: EESSSPVDEYTSSSDTLLESDS (MAGC1_HUMAN)
  Core: YTSSSDTLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EESSSPVDEXTSXSXTLXESDS

SEQ ID NO: 257277 - protein, 23 aa, Artificial Sequence
  Description of Artificial Sequence: Synthetic peptide
  Seed: EESSSPVDEYTSSSDTLLESDSL (MAGC1_HUMAN)
  Core: YTSSSDTLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EESSSPVDEXTSXSXTLXESDSL

SEQ ID NO: 257278 - protein, 24 aa, Artificial Sequence
  Description of Artificial Sequence: Synthetic peptide
  Seed: EESSSPVDEYTSSSDTLLESDSLT (MAGC1_HUMAN)
  Core: YTSSSDTLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EESSSPVDEXTSXSXTLXESDSLT

SEQ ID NO: 257279 - protein, 25 aa, Artificial Sequence
  Description of Artificial Sequence: Synthetic peptide
  Seed: EESSSPVDEYTSSSDTLLESDSLTD (MAGC1_HUMAN)
  Core: YTSSSDTLL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EESSSPVDEXTSXSXTLXESDSLTD

SEQ ID NO: 257280 - protein, 13 aa, Artificial Sequence
  Description of Artificial Sequence: Synthetic peptide
  Seed: EEVIWDVLSGIGV (MAGC1_HUMAN)
  Core: IWDVLSGIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEVXWDXLXGIXV

SEQ ID NO: 257281 - protein, 14 aa, Artificial Sequence
  Description of Artificial Sequence: Synthetic peptide
  Seed: EEVIWDVLSGIGVR (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVR

SEQ ID NO: 257282 - protein, 14 aa, Artificial Sequence
  Description of Artificial Sequence: Synthetic peptide
  Seed: EEVIWDVLSGIGVR (MAGC1_HUMAN)
  Core: IWDVLSGIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEVXWDXLXGIXVR

SEQ ID NO: 257283 - protein, 14 aa, Artificial Sequence
  Description of Artificial Sequence: Synthetic peptide
  Seed: EEVIWDVLSGIGVR (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXR

SEQ ID NO: 257284 - protein, 15 aa, Artificial Sequence
  Description of Artificial Sequence: Synthetic peptide
  Seed: EEVIWDVLSGIGVRA (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRA

SEQ ID NO: 257285 - protein, 15 aa, Artificial Sequence
  Description of Artificial Sequence: Synthetic peptide
  Seed: EEVIWDVLSGIGVRA (MAGC1_HUMAN)
  Core: IWDVLSGIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEVXWDXLXGIXVRA

SEQ ID NO: 257286 - protein, 15 aa, Artificial Sequence
  Description of Artificial Sequence: Synthetic peptide
  Seed: EEVIWDVLSGIGVRA (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRA

SEQ ID NO: 257287 - protein, 15 aa, Artificial Sequence
  Description of Artificial Sequence: Synthetic peptide
  Seed: EEVIWDVLSGIGVRA (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRX

SEQ ID NO: 257288 - protein, 16 aa, Artificial Sequence
  Description of Artificial Sequence: Synthetic peptide
  Seed: EEVIWDVLSGIGVRAG (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAG

SEQ ID NO: 257289 - protein, 16 aa, Artificial Sequence
  Description of Artificial Sequence: Synthetic peptide
  Seed: EEVIWDVLSGIGVRAG (MAGC1_HUMAN)
  Core: IWDVLSGIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEVXWDXLXGIXVRAG

SEQ ID NO: 257290 - protein, 16 aa, Artificial Sequence
  Description of Artificial Sequence: Synthetic peptide
  Seed: EEVIWDVLSGIGVRAG (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAG

SEQ ID NO: 257291 - protein, 16 aa, Artificial Sequence
  Description of Artificial Sequence: Synthetic peptide
  Seed: EEVIWDVLSGIGVRAG (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXG

SEQ ID NO: 257292 - protein, 16 aa, Artificial Sequence
  Description of Artificial Sequence: Synthetic peptide
  Seed: EEVIWDVLSGIGVRAG (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAX

SEQ ID NO: 257293 - protein, 17 aa, Artificial Sequence
  Description of Artificial Sequence: Synthetic peptide
  Seed: EEVIWDVLSGIGVRAGR (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAGR

SEQ ID NO: 257294 - protein, 17 aa, Artificial Sequence
  Description of Artificial Sequence: Synthetic peptide
  Seed: EEVIWDVLSGIGVRAGR (MAGC1_HUMAN)
  Core: IWDVLSGIG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EEVXWDXLXGIXVRAGR

SEQ ID NO: 257295 - protein, 17 aa, Artificial Sequence
  Description of Artificial Sequence: Synthetic peptide
  Seed: EEVIWDVLSGIGVRAGR (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGR

SEQ ID NO: 257296 - protein, 17 aa, Artificial Sequence
  Description of Artificial Sequence: Synthetic peptide
  Seed: EEVIWDVLSGIGVRAGR (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGR

SEQ ID NO: 257297 - protein, 17 aa, Artificial Sequence
  Description of Artificial Sequence: Synthetic peptide
  Seed: EEVIWDVLSGIGVRAGR (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXR

SEQ ID NO: 257298 - protein, 18 aa, Artificial Sequence
  Description of Artificial Sequence: Synthetic peptide
  Seed: EEVIWDVLSGIGVRAGRE (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGRE

SEQ ID NO: 257299 - protein, 18 aa, Artificial Sequence
  Description of Artificial Sequence: Synthetic peptide
  Seed: EEVIWDVLSGIGVRAGRE (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGRE

SEQ ID NO: 257300 - protein, 18 aa, Artificial Sequence
  Description of Artificial Sequence: Synthetic peptide
  Seed: EEVIWDVLSGIGVRAGRE (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXRE

SEQ ID NO: 257301 - protein, 19 aa, Artificial Sequence
  Description of Artificial Sequence: Synthetic peptide
  Seed: EEVIWDVLSGIGVRAGREH (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAGREH

SEQ ID NO: 257302 - protein, 19 aa, Artificial Sequence
  Description of Artificial Sequence: Synthetic peptide
  Seed: EEVIWDVLSGIGVRAGREH (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREH

SEQ ID NO: 257303 - protein, 19 aa, Artificial Sequence
  Description of Artificial Sequence: Synthetic peptide
  Seed: EEVIWDVLSGIGVRAGREH (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGREH

SEQ ID NO: 257304 - protein, 19 aa, Artificial Sequence
  Description of Artificial Sequence: Synthetic peptide
  Seed: EEVIWDVLSGIGVRAGREH (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREH

SEQ ID NO: 257305 - protein, 20 aa, Artificial Sequence
  Description of Artificial Sequence: Synthetic peptide
  Seed: EEVIWDVLSGIGVRAGREHF (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAGREHF

SEQ ID NO: 257306 - protein, 20 aa, Artificial Sequence
  Description of Artificial Sequence: Synthetic peptide
  Seed: EEVIWDVLSGIGVRAGREHF (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHF

SEQ ID NO: 257307 - protein, 20 aa, Artificial Sequence
  Description of Artificial Sequence: Synthetic peptide
  Seed: EEVIWDVLSGIGVRAGREHF (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGREHF

SEQ ID NO: 257308 - protein, 20 aa, Artificial Sequence
  Description of Artificial Sequence: Synthetic peptide
  Seed: EEVIWDVLSGIGVRAGREHF (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHF

SEQ ID NO: 257309 - protein, 21 aa, Artificial Sequence
  Description of Artificial Sequence: Synthetic peptide
  Seed: EEVIWDVLSGIGVRAGREHFA (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHFA

SEQ ID NO: 257310 - protein, 21 aa, Artificial Sequence
  Description of Artificial Sequence: Synthetic peptide
  Seed: EEVIWDVLSGIGVRAGREHFA (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGREHFA

SEQ ID NO: 257311 - protein, 21 aa, Artificial Sequence
  Description of Artificial Sequence: Synthetic peptide
  Seed: EEVIWDVLSGIGVRAGREHFA (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHFA

SEQ ID NO: 257312 - protein, 22 aa, Artificial Sequence
  Description of Artificial Sequence: Synthetic peptide
  Seed: EEVIWDVLSGIGVRAGREHFAF (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHFAF

SEQ ID NO: 257313 - protein, 22 aa, Artificial Sequence
  Description of Artificial Sequence: Synthetic peptide
  Seed: EEVIWDVLSGIGVRAGREHFAF (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGREHFAF

SEQ ID NO: 257314 - protein, 22 aa, Artificial Sequence
  Description of Artificial Sequence: Synthetic peptide
  Seed: EEVIWDVLSGIGVRAGREHFAF (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHFAF

SEQ ID NO: 257315 - protein, 23 aa, Artificial Sequence
  Description of Artificial Sequence: Synthetic peptide
  Seed: EEVIWDVLSGIGVRAGREHFAFG (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHFAFG

SEQ ID NO: 257316 - protein, 23 aa, Artificial Sequence
  Description of Artificial Sequence: Synthetic peptide
  Seed: EEVIWDVLSGIGVRAGREHFAFG (MAGC1_HUMAN)
  Core: VLSGIGVRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDXLSXIXVRXGREHFAFG

SEQ ID NO: 257317 - protein, 23 aa, Artificial Sequence
  Description of Artificial Sequence: Synthetic peptide
  Seed: EEVIWDVLSGIGVRAGREHFAFG (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHFAFG

SEQ ID NO: 257318 - protein, 23 aa, Artificial Sequence
  Description of Artificial Sequence: Synthetic peptide
  Seed: EEVIWDVLSGIGVRAGREHFAFG (MAGC1_HUMAN)
  Core: VRAGREHFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVLSGIGXRAXRXHFXFG

SEQ ID NO: 257319 - protein, 24 aa, Artificial Sequence
  Description of Artificial Sequence: Synthetic peptide
  Seed: EEVIWDVLSGIGVRAGREHFAFGE (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAGREHFAFGE

SEQ ID NO: 257320 - protein, 24 aa, Artificial Sequence
  Description of Artificial Sequence: Synthetic peptide
  Seed: EEVIWDVLSGIGVRAGREHFAFGE (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHFAFGE

SEQ ID NO: 257321 - protein, 24 aa, Artificial Sequence
  Description of Artificial Sequence: Synthetic peptide
  Seed: EEVIWDVLSGIGVRAGREHFAFGE (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHFAFGE

SEQ ID NO: 257322 - protein, 24 aa, Artificial Sequence
  Description of Artificial Sequence: Synthetic peptide
  Seed: EEVIWDVLSGIGVRAGREHFAFGE (MAGC1_HUMAN)
  Core: VRAGREHFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVLSGIGXRAXRXHFXFGE

SEQ ID NO: 257323 - protein, 25 aa, Artificial Sequence
  Description of Artificial Sequence: Synthetic peptide
  Seed: EEVIWDVLSGIGVRAGREHFAFGEP (MAGC1_HUMAN)
  Core: VIWDVLSGI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EEXIWXVXSGXGVRAGREHFAFGEP

SEQ ID NO: 257324 - protein, 25 aa, Artificial Sequence
  Description of Artificial Sequence: Synthetic peptide
  Seed: EEVIWDVLSGIGVRAGREHFAFGEP (MAGC1_HUMAN)
  Core: WDVLSGIGV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EEVIXDVXSXIGXRAGREHFAFGEP

SEQ ID NO: 257325 - protein, 25 aa, Artificial Sequence
  Description of Artificial Sequence: Synthetic peptide
  Seed: EEVIWDVLSGIGVRAGREHFAFGEP (MAGC1_HUMAN)
  Core: LSGIGVRAG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVXSGXGXRAXREHFAFGEP

SEQ ID NO: 257326 - protein, 25 aa, Artificial Sequence
  Description of Artificial Sequence: Synthetic peptide
  Seed: EEVIWDVLSGIGVRAGREHFAFGEP (MAGC1_HUMAN)
  Core: IGVRAGREH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVLSGXGVXAXREXFAFGEP

SEQ ID NO: 257327 - protein, 25 aa, Artificial Sequence
  Description of Artificial Sequence: Synthetic peptide
  Seed: EEVIWDVLSGIGVRAGREHFAFGEP (MAGC1_HUMAN)
  Core: VRAGREHFA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
EEVIWDVLSGIGXRAXRXHFXFGEP

SEQ ID NO: 257328 - protein, 13 aa, Artificial Sequence
  Description of Artificial Sequence: Synthetic peptide
  Seed: EFIEILFGISLRE (MAGC1_HUMAN)
  Core: FIEILFGIS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXIEXLXGIXLRE

SEQ ID NO: 257329 - protein, 13 aa, Artificial Sequence
  Description of Artificial Sequence: Synthetic peptide
  Seed: EFIEILFGISLRE (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXRE

SEQ ID NO: 257330 - protein, 14 aa, Artificial Sequence
  Description of Artificial Sequence: Synthetic peptide
  Seed: EFIEILFGISLREV (MAGC1_HUMAN)
  Core: FIEILFGIS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXIEXLXGIXLREV

SEQ ID NO: 257331 - protein, 14 aa, Artificial Sequence
  Description of Artificial Sequence: Synthetic peptide
  Seed: EFIEILFGISLREV (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXREV

SEQ ID NO: 257332 - protein, 14 aa, Artificial Sequence
  Description of Artificial Sequence: Synthetic peptide
  Seed: EFIEILFGISLREV (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXV

SEQ ID NO: 257333 - protein, 14 aa, Artificial Sequence
  Description of Artificial Sequence: Synthetic peptide
  Seed: EFIEILFGISLREV (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREX

SEQ ID NO: 257334 - protein, 15 aa, Artificial Sequence
  Description of Artificial Sequence: Synthetic peptide
  Seed: EFIEILFGISLREVD (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXREVD

SEQ ID NO: 257335 - protein, 15 aa, Artificial Sequence
  Description of Artificial Sequence: Synthetic peptide
  Seed: EFIEILFGISLREVD (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVD

SEQ ID NO: 257336 - protein, 15 aa, Artificial Sequence
  Description of Artificial Sequence: Synthetic peptide
  Seed: EFIEILFGISLREVD (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXD

SEQ ID NO: 257337 - protein, 15 aa, Artificial Sequence
  Description of Artificial Sequence: Synthetic peptide
  Seed: EFIEILFGISLREVD (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVX

SEQ ID NO: 257338 - protein, 16 aa, Artificial Sequence
  Description of Artificial Sequence: Synthetic peptide
  Seed: EFIEILFGISLREVDP (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXREVDP

SEQ ID NO: 257339 - protein, 16 aa, Artificial Sequence
  Description of Artificial Sequence: Synthetic peptide
  Seed: EFIEILFGISLREVDP (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDP

SEQ ID NO: 257340 - protein, 16 aa, Artificial Sequence
  Description of Artificial Sequence: Synthetic peptide
  Seed: EFIEILFGISLREVDP (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDP

SEQ ID NO: 257341 - protein, 16 aa, Artificial Sequence
  Description of Artificial Sequence: Synthetic peptide
  Seed: EFIEILFGISLREVDP (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXP

SEQ ID NO: 257342 - protein, 17 aa, Artificial Sequence
  Description of Artificial Sequence: Synthetic peptide
  Seed: EFIEILFGISLREVDPD (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXREVDPD

SEQ ID NO: 257343 - protein, 17 aa, Artificial Sequence
  Description of Artificial Sequence: Synthetic peptide
  Seed: EFIEILFGISLREVDPD (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDPD

SEQ ID NO: 257344 - protein, 17 aa, Artificial Sequence
  Description of Artificial Sequence: Synthetic peptide
  Seed: EFIEILFGISLREVDPD (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPD

SEQ ID NO: 257345 - protein, 17 aa, Artificial Sequence
  Description of Artificial Sequence: Synthetic peptide
  Seed: EFIEILFGISLREVDPD (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPD

SEQ ID NO: 257346 - protein, 18 aa, Artificial Sequence
  Description of Artificial Sequence: Synthetic peptide
  Seed: EFIEILFGISLREVDPDD (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDD

SEQ ID NO: 257347 - protein, 19 aa, Artificial Sequence
  Description of Artificial Sequence: Synthetic peptide
  Seed: EFIEILFGISLREVDPDDS (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDPDDS

SEQ ID NO: 257348 - protein, 19 aa, Artificial Sequence
  Description of Artificial Sequence: Synthetic peptide
  Seed: EFIEILFGISLREVDPDDS (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDS

SEQ ID NO: 257349 - protein, 19 aa, Artificial Sequence
  Description of Artificial Sequence: Synthetic peptide
  Seed: EFIEILFGISLREVDPDDS (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDS

SEQ ID NO: 257350 - protein, 20 aa, Artificial Sequence
  Description of Artificial Sequence: Synthetic peptide
  Seed: EFIEILFGISLREVDPDDSY (MAGC1_HUMAN)
  Core: IEILFGISL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXEIXFXISXREVDPDDSY

SEQ ID NO: 257351 - protein, 20 aa, Artificial Sequence
  Description of Artificial Sequence: Synthetic peptide
  Seed: EFIEILFGISLREVDPDDSY (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDPDDSY

SEQ ID NO: 257352 - protein, 20 aa, Artificial Sequence
  Description of Artificial Sequence: Synthetic peptide
  Seed: EFIEILFGISLREVDPDDSY (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSY

SEQ ID NO: 257353 - protein, 20 aa, Artificial Sequence
  Description of Artificial Sequence: Synthetic peptide
  Seed: EFIEILFGISLREVDPDDSY (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSY

SEQ ID NO: 257354 - protein, 20 aa, Artificial Sequence
  Description of Artificial Sequence: Synthetic peptide
  Seed: EFIEILFGISLREVDPDDSY (MAGC1_HUMAN)
  Core: ISLREVDPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGXSLXEXDPXDSY

SEQ ID NO: 257355 - protein, 21 aa, Artificial Sequence
  Description of Artificial Sequence: Synthetic peptide
  Seed: EFIEILFGISLREVDPDDSYV (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDPDDSYV

SEQ ID NO: 257356 - protein, 21 aa, Artificial Sequence
  Description of Artificial Sequence: Synthetic peptide
  Seed: EFIEILFGISLREVDPDDSYV (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSYV

SEQ ID NO: 257357 - protein, 21 aa, Artificial Sequence
  Description of Artificial Sequence: Synthetic peptide
  Seed: EFIEILFGISLREVDPDDSYV (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSYV

SEQ ID NO: 257358 - protein, 22 aa, Artificial Sequence
  Description of Artificial Sequence: Synthetic peptide
  Seed: EFIEILFGISLREVDPDDSYVF (MAGC1_HUMAN)
  Core: ILFGISLRE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFIEXLFXIXLRXVDPDDSYVF

SEQ ID NO: 257359 - protein, 22 aa, Artificial Sequence
  Description of Artificial Sequence: Synthetic peptide
  Seed: EFIEILFGISLREVDPDDSYVF (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSYVF

SEQ ID NO: 257360 - protein, 22 aa, Artificial Sequence
  Description of Artificial Sequence: Synthetic peptide
  Seed: EFIEILFGISLREVDPDDSYVF (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSYVF

SEQ ID NO: 257361 - protein, 22 aa, Artificial Sequence
  Description of Artificial Sequence: Synthetic peptide
  Seed: EFIEILFGISLREVDPDDSYVF (MAGC1_HUMAN)
  Core: LREVDPDDS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGISXREXDXDDXYVF

SEQ ID NO: 257362 - protein, 23 aa, Artificial Sequence
  Description of Artificial Sequence: Synthetic peptide
  Seed: EFIEILFGISLREVDPDDSYVFV (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSYVFV

SEQ ID NO: 257363 - protein, 23 aa, Artificial Sequence
  Description of Artificial Sequence: Synthetic peptide
  Seed: EFIEILFGISLREVDPDDSYVFV (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSYVFV

SEQ ID NO: 257364 - protein, 23 aa, Artificial Sequence
  Description of Artificial Sequence: Synthetic peptide
  Seed: EFIEILFGISLREVDPDDSYVFV (MAGC1_HUMAN)
  Core: ISLREVDPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGXSLXEXDPXDSYVFV

SEQ ID NO: 257365 - protein, 23 aa, Artificial Sequence
  Description of Artificial Sequence: Synthetic peptide
  Seed: EFIEILFGISLREVDPDDSYVFV (MAGC1_HUMAN)
  Core: LREVDPDDS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGISXREXDXDDXYVFV

SEQ ID NO: 257366 - protein, 24 aa, Artificial Sequence
  Description of Artificial Sequence: Synthetic peptide
  Seed: EFIEILFGISLREVDPDDSYVFVN (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSYVFVN

SEQ ID NO: 257367 - protein, 24 aa, Artificial Sequence
  Description of Artificial Sequence: Synthetic peptide
  Seed: EFIEILFGISLREVDPDDSYVFVN (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSYVFVN

SEQ ID NO: 257368 - protein, 24 aa, Artificial Sequence
  Description of Artificial Sequence: Synthetic peptide
  Seed: EFIEILFGISLREVDPDDSYVFVN (MAGC1_HUMAN)
  Core: ISLREVDPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGXSLXEXDPXDSYVFVN

SEQ ID NO: 257369 - protein, 24 aa, Artificial Sequence
  Description of Artificial Sequence: Synthetic peptide
  Seed: EFIEILFGISLREVDPDDSYVFVN (MAGC1_HUMAN)
  Core: LREVDPDDS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGISXREXDXDDXYVFVN

SEQ ID NO: 257370 - protein, 25 aa, Artificial Sequence
  Description of Artificial Sequence: Synthetic peptide
  Seed: EFIEILFGISLREVDPDDSYVFVNT (MAGC1_HUMAN)
  Core: LFGISLREV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFIEIXFGXSXREXDPDDSYVFVNT

SEQ ID NO: 257371 - protein, 25 aa, Artificial Sequence
  Description of Artificial Sequence: Synthetic peptide
  Seed: EFIEILFGISLREVDPDDSYVFVNT (MAGC1_HUMAN)
  Core: FGISLREVD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILXGIXLXEVXPDDSYVFVNT

SEQ ID NO: 257372 - protein, 25 aa, Artificial Sequence
  Description of Artificial Sequence: Synthetic peptide
  Seed: EFIEILFGISLREVDPDDSYVFVNT (MAGC1_HUMAN)
  Core: ISLREVDPD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGXSLXEXDPXDSYVFVNT

SEQ ID NO: 257373 - protein, 25 aa, Artificial Sequence
  Description of Artificial Sequence: Synthetic peptide
  Seed: EFIEILFGISLREVDPDDSYVFVNT (MAGC1_HUMAN)
  Core: LREVDPDDS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFIEILFGISXREXDXDDXYVFVNT

SEQ ID NO: 257374 - protein, 13 aa, Artificial Sequence
  Description of Artificial Sequence: Synthetic peptide
  Seed: EFLAMLKNTVPIT (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPIT

SEQ ID NO: 257375 - protein, 13 aa, Artificial Sequence
  Description of Artificial Sequence: Synthetic peptide
  Seed: EFLAMLKNTVPIT (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXIT

SEQ ID NO: 257376 - protein, 14 aa, Artificial Sequence
  Description of Artificial Sequence: Synthetic peptide
  Seed: EFLAMLKNTVPITF (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITF

SEQ ID NO: 257377 - protein, 14 aa, Artificial Sequence
  Description of Artificial Sequence: Synthetic peptide
  Seed: EFLAMLKNTVPITF (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITF

SEQ ID NO: 257378 - protein, 14 aa, Artificial Sequence
  Description of Artificial Sequence: Synthetic peptide
  Seed: EFLAMLKNTVPITF (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXF

SEQ ID NO: 257379 - protein, 14 aa, Artificial Sequence
  Description of Artificial Sequence: Synthetic peptide
  Seed: EFLAMLKNTVPITF (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITX

SEQ ID NO: 257380 - protein, 15 aa, Artificial Sequence
  Description of Artificial Sequence: Synthetic peptide
  Seed: EFLAMLKNTVPITFP (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFP

SEQ ID NO: 257381 - protein, 15 aa, Artificial Sequence
  Description of Artificial Sequence: Synthetic peptide
  Seed: EFLAMLKNTVPITFP (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITFP

SEQ ID NO: 257382 - protein, 15 aa, Artificial Sequence
  Description of Artificial Sequence: Synthetic peptide
  Seed: EFLAMLKNTVPITFP (MAGC1_HUMAN)
  Core: AMLKNTVPI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EFLXMLXNXVPXTFP

SEQ ID NO: 257383 - protein, 15 aa, Artificial Sequence
  Description of Artificial Sequence: Synthetic peptide
  Seed: EFLAMLKNTVPITFP (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFP

SEQ ID NO: 257384 - protein, 15 aa, Artificial Sequence
  Description of Artificial Sequence: Synthetic peptide
  Seed: EFLAMLKNTVPITFP (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXP

SEQ ID NO: 257385 - protein, 16 aa, Artificial Sequence
  Description of Artificial Sequence: Synthetic peptide
  Seed: EFLAMLKNTVPITFPS (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPS

SEQ ID NO: 257386 - protein, 16 aa, Artificial Sequence
  Description of Artificial Sequence: Synthetic peptide
  Seed: EFLAMLKNTVPITFPS (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITFPS

SEQ ID NO: 257387 - protein, 16 aa, Artificial Sequence
  Description of Artificial Sequence: Synthetic peptide
  Seed: EFLAMLKNTVPITFPS (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPS

SEQ ID NO: 257388 - protein, 16 aa, Artificial Sequence
  Description of Artificial Sequence: Synthetic peptide
  Seed: EFLAMLKNTVPITFPS (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPS

SEQ ID NO: 257389 - protein, 17 aa, Artificial Sequence
  Description of Artificial Sequence: Synthetic peptide
  Seed: EFLAMLKNTVPITFPSS (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSS

SEQ ID NO: 257390 - protein, 17 aa, Artificial Sequence
  Description of Artificial Sequence: Synthetic peptide
  Seed: EFLAMLKNTVPITFPSS (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITFPSS

SEQ ID NO: 257391 - protein, 17 aa, Artificial Sequence
  Description of Artificial Sequence: Synthetic peptide
  Seed: EFLAMLKNTVPITFPSS (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSS

SEQ ID NO: 257392 - protein, 17 aa, Artificial Sequence
  Description of Artificial Sequence: Synthetic peptide
  Seed: EFLAMLKNTVPITFPSS (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSS

SEQ ID NO: 257393 - protein, 18 aa, Artificial Sequence
  Description of Artificial Sequence: Synthetic peptide
  Seed: EFLAMLKNTVPITFPSSY (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSSY

SEQ ID NO: 257394 - protein, 18 aa, Artificial Sequence
  Description of Artificial Sequence: Synthetic peptide
  Seed: EFLAMLKNTVPITFPSSY (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSY

SEQ ID NO: 257395 - protein, 18 aa, Artificial Sequence
  Description of Artificial Sequence: Synthetic peptide
  Seed: EFLAMLKNTVPITFPSSY (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSY

SEQ ID NO: 257396 - protein, 19 aa, Artificial Sequence
  Description of Artificial Sequence: Synthetic peptide
  Seed: EFLAMLKNTVPITFPSSYK (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSSYK

SEQ ID NO: 257397 - protein, 19 aa, Artificial Sequence
  Description of Artificial Sequence: Synthetic peptide
  Seed: EFLAMLKNTVPITFPSSYK (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITFPSSYK

SEQ ID NO: 257398 - protein, 19 aa, Artificial Sequence
  Description of Artificial Sequence: Synthetic peptide
  Seed: EFLAMLKNTVPITFPSSYK (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYK

SEQ ID NO: 257399 - protein, 19 aa, Artificial Sequence
  Description of Artificial Sequence: Synthetic peptide
  Seed: EFLAMLKNTVPITFPSSYK (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYK

SEQ ID NO: 257400 - protein, 19 aa, Artificial Sequence
  Description of Artificial Sequence: Synthetic peptide
  Seed: EFLAMLKNTVPITFPSSYK (MAGC1_HUMAN)
  Core: NTVPITFPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKXTVXIXFPXSYK

SEQ ID NO: 257401 - protein, 19 aa, Artificial Sequence
  Description of Artificial Sequence: Synthetic peptide
  Seed: EFLAMLKNTVPITFPSSYK (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYK

SEQ ID NO: 257402 - protein, 20 aa, Artificial Sequence
  Description of Artificial Sequence: Synthetic peptide
  Seed: EFLAMLKNTVPITFPSSYKD (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSSYKD

SEQ ID NO: 257403 - protein, 20 aa, Artificial Sequence
  Description of Artificial Sequence: Synthetic peptide
  Seed: EFLAMLKNTVPITFPSSYKD (MAGC1_HUMAN)
  Core: LAMLKNTVP
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXAMXKXTVXITFPSSYKD

SEQ ID NO: 257404 - protein, 20 aa, Artificial Sequence
  Description of Artificial Sequence: Synthetic peptide
  Seed: EFLAMLKNTVPITFPSSYKD (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKD

SEQ ID NO: 257405 - protein, 20 aa, Artificial Sequence
  Description of Artificial Sequence: Synthetic peptide
  Seed: EFLAMLKNTVPITFPSSYKD (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKD

SEQ ID NO: 257406 - protein, 20 aa, Artificial Sequence
  Description of Artificial Sequence: Synthetic peptide
  Seed: EFLAMLKNTVPITFPSSYKD (MAGC1_HUMAN)
  Core: NTVPITFPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKXTVXIXFPXSYKD

SEQ ID NO: 257407 - protein, 20 aa, Artificial Sequence
  Description of Artificial Sequence: Synthetic peptide
  Seed: EFLAMLKNTVPITFPSSYKD (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKD

SEQ ID NO: 257408 - protein, 20 aa, Artificial Sequence
  Description of Artificial Sequence: Synthetic peptide
  Seed: EFLAMLKNTVPITFPSSYKD (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXD

SEQ ID NO: 257409 - protein, 21 aa, Artificial Sequence
  Description of Artificial Sequence: Synthetic peptide
  Seed: EFLAMLKNTVPITFPSSYKDA (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSSYKDA

SEQ ID NO: 257410 - protein, 21 aa, Artificial Sequence
  Description of Artificial Sequence: Synthetic peptide
  Seed: EFLAMLKNTVPITFPSSYKDA (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKDA

SEQ ID NO: 257411 - protein, 21 aa, Artificial Sequence
  Description of Artificial Sequence: Synthetic peptide
  Seed: EFLAMLKNTVPITFPSSYKDA (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKDA

SEQ ID NO: 257412 - protein, 21 aa, Artificial Sequence
  Description of Artificial Sequence: Synthetic peptide
  Seed: EFLAMLKNTVPITFPSSYKDA (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKDA

SEQ ID NO: 257413 - protein, 21 aa, Artificial Sequence
  Description of Artificial Sequence: Synthetic peptide
  Seed: EFLAMLKNTVPITFPSSYKDA (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXDA

SEQ ID NO: 257414 - protein, 21 aa, Artificial Sequence
  Description of Artificial Sequence: Synthetic peptide
  Seed: EFLAMLKNTVPITFPSSYKDA (MAGC1_HUMAN)
  Core: ITFPSSYKD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPXTFXSXYKXA

SEQ ID NO: 257415 - protein, 22 aa, Artificial Sequence
  Description of Artificial Sequence: Synthetic peptide
  Seed: EFLAMLKNTVPITFPSSYKDAL (MAGC1_HUMAN)
  Core: FLAMLKNTV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLAXLXNTXPITFPSSYKDAL

SEQ ID NO: 257416 - protein, 22 aa, Artificial Sequence
  Description of Artificial Sequence: Synthetic peptide
  Seed: EFLAMLKNTVPITFPSSYKDAL (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKDAL

SEQ ID NO: 257417 - protein, 22 aa, Artificial Sequence
  Description of Artificial Sequence: Synthetic peptide
  Seed: EFLAMLKNTVPITFPSSYKDAL (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKDAL

SEQ ID NO: 257418 - protein, 22 aa, Artificial Sequence
  Description of Artificial Sequence: Synthetic peptide
  Seed: EFLAMLKNTVPITFPSSYKDAL (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKDAL

SEQ ID NO: 257419 - protein, 22 aa, Artificial Sequence
  Description of Artificial Sequence: Synthetic peptide
  Seed: EFLAMLKNTVPITFPSSYKDAL (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXDAL

SEQ ID NO: 257420 - protein, 22 aa, Artificial Sequence
  Description of Artificial Sequence: Synthetic peptide
  Seed: EFLAMLKNTVPITFPSSYKDAL (MAGC1_HUMAN)
  Core: ITFPSSYKD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPXTFXSXYKXAL

SEQ ID NO: 257421 - protein, 23 aa, Artificial Sequence
  Description of Artificial Sequence: Synthetic peptide
  Seed: EFLAMLKNTVPITFPSSYKDALK (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKDALK

SEQ ID NO: 257422 - protein, 23 aa, Artificial Sequence
  Description of Artificial Sequence: Synthetic peptide
  Seed: EFLAMLKNTVPITFPSSYKDALK (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKDALK

SEQ ID NO: 257423 - protein, 23 aa, Artificial Sequence
  Description of Artificial Sequence: Synthetic peptide
  Seed: EFLAMLKNTVPITFPSSYKDALK (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKDALK

SEQ ID NO: 257424 - protein, 23 aa, Artificial Sequence
  Description of Artificial Sequence: Synthetic peptide
  Seed: EFLAMLKNTVPITFPSSYKDALK (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXDALK

SEQ ID NO: 257425 - protein, 23 aa, Artificial Sequence
  Description of Artificial Sequence: Synthetic peptide
  Seed: EFLAMLKNTVPITFPSSYKDALK (MAGC1_HUMAN)
  Core: ITFPSSYKD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPXTFXSXYKXALK

SEQ ID NO: 257426 - protein, 24 aa, Artificial Sequence
  Description of Artificial Sequence: Synthetic peptide
  Seed: EFLAMLKNTVPITFPSSYKDALKD (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKDALKD

SEQ ID NO: 257427 - protein, 24 aa, Artificial Sequence
  Description of Artificial Sequence: Synthetic peptide
  Seed: EFLAMLKNTVPITFPSSYKDALKD (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKDALKD

SEQ ID NO: 257428 - protein, 24 aa, Artificial Sequence
  Description of Artificial Sequence: Synthetic peptide
  Seed: EFLAMLKNTVPITFPSSYKDALKD (MAGC1_HUMAN)
  Core: NTVPITFPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKXTVXIXFPXSYKDALKD

SEQ ID NO: 257429 - protein, 24 aa, Artificial Sequence
  Description of Artificial Sequence: Synthetic peptide
  Seed: EFLAMLKNTVPITFPSSYKDALKD (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKDALKD

SEQ ID NO: 257430 - protein, 24 aa, Artificial Sequence
  Description of Artificial Sequence: Synthetic peptide
  Seed: EFLAMLKNTVPITFPSSYKDALKD (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXDALKD

SEQ ID NO: 257431 - protein, 24 aa, Artificial Sequence
  Description of Artificial Sequence: Synthetic peptide
  Seed: EFLAMLKNTVPITFPSSYKDALKD (MAGC1_HUMAN)
  Core: ITFPSSYKD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPXTFXSXYKXALKD

SEQ ID NO: 257432 - protein, 25 aa, Artificial Sequence
  Description of Artificial Sequence: Synthetic peptide
  Seed: EFLAMLKNTVPITFPSSYKDALKDV (MAGC1_HUMAN)
  Core: MLKNTVPIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
EFLAXLKXTXPIXFPSSYKDALKDV

SEQ ID NO: 257433 - protein, 25 aa, Artificial Sequence
  Description of Artificial Sequence: Synthetic peptide
  Seed: EFLAMLKNTVPITFPSSYKDALKDV (MAGC1_HUMAN)
  Core: LKNTVPITF
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMXKNXVXITXPSSYKDALKDV

SEQ ID NO: 257434 - protein, 25 aa, Artificial Sequence
  Description of Artificial Sequence: Synthetic peptide
  Seed: EFLAMLKNTVPITFPSSYKDALKDV (MAGC1_HUMAN)
  Core: NTVPITFPS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKXTVXIXFPXSYKDALKDV

SEQ ID NO: 257435 - protein, 25 aa, Artificial Sequence
  Description of Artificial Sequence: Synthetic peptide
  Seed: EFLAMLKNTVPITFPSSYKDALKDV (MAGC1_HUMAN)
  Core: TVPITFPSS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNXVPXTXPSXYKDALKDV

SEQ ID NO: 257436 - protein, 25 aa, Artificial Sequence
  Description of Artificial Sequence: Synthetic peptide
  Seed: EFLAMLKNTVPITFPSSYKDALKDV (MAGC1_HUMAN)
  Core: PITFPSSYK
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVXITXPXSYXDALKDV

SEQ ID NO: 257437 - protein, 25 aa, Artificial Sequence
  Description of Artificial Sequence: Synthetic peptide
  Seed: EFLAMLKNTVPITFPSSYKDALKDV (MAGC1_HUMAN)
  Core: ITFPSSYKD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPXTFXSXYKXALKDV

SEQ ID NO: 257438 - protein, 25 aa, Artificial Sequence
  Description of Artificial Sequence: Synthetic peptide
  Seed: EFLAMLKNTVPITFPSSYKDALKDV (MAGC1_HUMAN)
  Core: FPSSYKDAL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
EFLAMLKNTVPITXPSXYXDAXKDV

SEQ ID NO: 257439 - protein, 14 aa, Artificial Sequence
  Description of Artificial Sequence: Synthetic peptide
  Seed: EFLWGPRAHSEVIK (MAGC1_HUMAN)
  Core: FLWGPRAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLWXPXAHXEVIK

SEQ ID NO: 257440 - protein, 15 aa, Artificial Sequence
  Description of Artificial Sequence: Synthetic peptide
  Seed: EFLWGPRAHSEVIKR (MAGC1_HUMAN)
  Core: FLWGPRAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLWXPXAHXEVIKR

SEQ ID NO: 257441 - protein, 15 aa, Artificial Sequence
  Description of Artificial Sequence: Synthetic peptide
  Seed: EFLWGPRAHSEVIKR (MAGC1_HUMAN)
  Core: LWGPRAHSE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXWGXRXHSXVIKR

SEQ ID NO: 257442 - protein, 15 aa, Artificial Sequence
  Description of Artificial Sequence: Synthetic peptide
  Seed: EFLWGPRAHSEVIKR (MAGC1_HUMAN)
  Core: WGPRAHSEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
EFLXGPXAXSEXIKR

SEQ ID NO: 257443 - protein, 16 aa, Artificial Sequence
  Description of Artificial Sequence: Synthetic peptide
  Seed: EFLWGPRAHSEVIKRK (MAGC1_HUMAN)
  Core: FLWGPRAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLWXPXAHXEVIKRK

SEQ ID NO: 257444 - protein, 17 aa, Artificial Sequence
  Description of Artificial Sequence: Synthetic peptide
  Seed: EFLWGPRAHSEVIKRKV (MAGC1_HUMAN)
  Core: FLWGPRAHS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
EXLWXPXAHXEVIKRKV

SEQ ID NO: 257445 - protein, 17 aa, Artificial Sequence
  Description of Artificial Sequence: Synthetic peptide
  Seed: EFLWGPRAHSEVIKRKV (MAGC1_HUMAN)
  Core: PRAHSEVIK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGXRAXSXVIXRKV

SEQ ID NO: 257446 - protein, 17 aa, Artificial Sequence
  Description of Artificial Sequence: Synthetic peptide
  Seed: EFLWGPRAHSEVIKRKV (MAGC1_HUMAN)
  Core: RAHSEVIKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPXAHXEXIKXKV

SEQ ID NO: 257447 - protein, 19 aa, Artificial Sequence
  Description of Artificial Sequence: Synthetic peptide
  Seed: EFLWGPRAHSEVIKRKVVE (MAGC1_HUMAN)
  Core: RAHSEVIKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPXAHXEXIKXKVVE

SEQ ID NO: 257448 - protein, 20 aa, Artificial Sequence
  Description of Artificial Sequence: Synthetic peptide
  Seed: EFLWGPRAHSEVIKRKVVEF (MAGC1_HUMAN)
  Core: PRAHSEVIK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGXRAXSXVIXRKVVEF

SEQ ID NO: 257449 - protein, 20 aa, Artificial Sequence
  Description of Artificial Sequence: Synthetic peptide
  Seed: EFLWGPRAHSEVIKRKVVEF (MAGC1_HUMAN)
  Core: RAHSEVIKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPXAHXEXIKXKVVEF

SEQ ID NO: 257450 - protein, 20 aa, Artificial Sequence
  Description of Artificial Sequence: Synthetic peptide
  Seed: EFLWGPRAHSEVIKRKVVEF (MAGC1_HUMAN)
  Core: AHSEVIKRK
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRXHSXVXKRXVVEF

SEQ ID NO: 257451 - protein, 20 aa, Artificial Sequence
  Description of Artificial Sequence: Synthetic peptide
  Seed: EFLWGPRAHSEVIKRKVVEF (MAGC1_HUMAN)
  Core: HSEVIKRKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAXSEXIXRKXVEF

SEQ ID NO: 257452 - protein, 20 aa, Artificial Sequence
  Description of Artificial Sequence: Synthetic peptide
  Seed: EFLWGPRAHSEVIKRKVVEF (MAGC1_HUMAN)
  Core: SEVIKRKVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAHXEVXKXKVXEF

SEQ ID NO: 257453 - protein, 21 aa, Artificial Sequence
  Description of Artificial Sequence: Synthetic peptide
  Seed: EFLWGPRAHSEVIKRKVVEFL (MAGC1_HUMAN)
  Core: RAHSEVIKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPXAHXEXIKXKVVEFL

SEQ ID NO: 257454 - protein, 21 aa, Artificial Sequence
  Description of Artificial Sequence: Synthetic peptide
  Seed: EFLWGPRAHSEVIKRKVVEFL (MAGC1_HUMAN)
  Core: HSEVIKRKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAXSEXIXRKXVEFL

SEQ ID NO: 257455 - protein, 21 aa, Artificial Sequence
  Description of Artificial Sequence: Synthetic peptide
  Seed: EFLWGPRAHSEVIKRKVVEFL (MAGC1_HUMAN)
  Core: SEVIKRKVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAHXEVXKXKVXEFL

SEQ ID NO: 257456 - protein, 22 aa, Artificial Sequence
  Description of Artificial Sequence: Synthetic peptide
  Seed: EFLWGPRAHSEVIKRKVVEFLA (MAGC1_HUMAN)
  Core: PRAHSEVIK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGXRAXSXVIXRKVVEFLA

SEQ ID NO: 257457 - protein, 22 aa, Artificial Sequence
  Description of Artificial Sequence: Synthetic peptide
  Seed: EFLWGPRAHSEVIKRKVVEFLA (MAGC1_HUMAN)
  Core: RAHSEVIKR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPXAHXEXIKXKVVEFLA

SEQ ID NO: 257458 - protein, 22 aa, Artificial Sequence
  Description of Artificial Sequence: Synthetic peptide
  Seed: EFLWGPRAHSEVIKRKVVEFLA (MAGC1_HUMAN)
  Core: HSEVIKRKV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAXSEXIXRKXVEFLA

SEQ ID NO: 257459 - protein, 22 aa, Artificial Sequence
  Description of Artificial Sequence: Synthetic peptide
  Seed: EFLWGPRAHSEVIKRKVVEFLA (MAGC1_HUMAN)
  Core: SEVIKRKVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAHXEVXKXKVXEFLA

SEQ ID NO: 257460 - protein, 22 aa, Artificial Sequence
  Description of Artificial Sequence: Synthetic peptide
  Seed: EFLWGPRAHSEVIKRKVVEFLA (MAGC1_HUMAN)
  Core: EVIKRKVVE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAHSXVIXRXVVXFLA

SEQ ID NO: 257461 - protein, 22 aa, Artificial Sequence
  Description of Artificial Sequence: Synthetic peptide
  Seed: EFLWGPRAHSEVIKRKVVEFLA (MAGC1_HUMAN)
  Core: VIKRKVVEF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
EFLWGPRAHSEXIKXKXVEXLA

SEQ ID NO: 257462 - protein, 23 aa, Artificial Sequence
  Description of Artificial Sequence: Synthetic peptide
  Seed: EFLWGPRAHSEVIKRKVVEFLAM (MAGC1_HUMAN)
  Core: LWGPRAHSE
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
EFXWGXRXHSXVIKRKVVEFLAM
